US 7,892,565 B2

(12) United States Patent
Steward et al.

(10) Patent No.: US 7,892,565 B2
(45) Date of Patent: *Feb. 22, 2011

(54) DEGRADABLE CLOSTRIDIAL TOXINS

(75) Inventors: Lance E. Steward, Irvine, CA (US);
Ester G. Fernandez-Salas, Fullerton, CA (US); Marcella A. Gilmore, Santa Ana, CA (US); Joseph Francis, Aliso Viejo, CA (US); Shengwen Li, Irvine, CA (US); Kei Roger Aoki, Coto de Caza, CA (US)

(73) Assignee: Allergan, Inc., Irvine, CA (US)

( * ) Notice: Subject to any disclaimer, the term of this patent is extended or adjusted under 35 U.S.C. 154(b) by 540 days.

This patent is subject to a terminal disclaimer.

(21) Appl. No.: 11/572,512

(22) PCT Filed: Sep. 1, 2005

(86) PCT No.: PCT/US2005/031613
§ 371 (c)(1),
(2), (4) Date: Jul. 17, 2007

(87) PCT Pub. No.: WO2006/026780
PCT Pub. Date: Mar. 9, 2006

(65) Prior Publication Data
US 2008/0213830 A1    Sep. 4, 2008

Related U.S. Application Data

(60) Provisional application No. 60/651,494, filed on Sep. 1, 2004.

(51) Int. Cl.
C07K 1/00    (2006.01)
C07K 14/00   (2006.01)
C07H 21/02   (2006.01)

(52) U.S. Cl. .............. 424/239.1; 424/236.1; 435/69.1; 514/12; 530/350; 536/23.7

(58) Field of Classification Search .............. 424/239.1, 424/236.1, 9.1; 514/2, 12; 530/350; 435/252.7, 435/69.1; 536/23.7
See application file for complete search history.

(56) References Cited

U.S. PATENT DOCUMENTS

| 6,168,932 | B1 | 1/2001 | Uckun et al. |
| 6,395,513 | B1 | 5/2002 | Foster et al. |
| 6,461,617 | B1 | 10/2002 | Shone et al. |
| 7,052,702 | B1 | 5/2006 | Duggan et al. |
| 7,132,259 | B1 | 11/2006 | Dolly et al. |
| 7,192,596 | B2 | 3/2007 | Shone et al. |
| 2002/0137886 | A1 | 9/2002 | Lin et al. |
| 2003/0124147 | A1 | 7/2003 | Vallera et al. |
| 2003/0180289 | A1 | 9/2003 | Foster et al. |
| 2004/0071736 | A1 | 4/2004 | Quinn et al. |
| 2008/0032931 | A1 | 2/2008 | Steward et al. |
| 2008/0081355 | A1 | 4/2008 | Dolly et al. |
| 2008/0161226 | A1 | 7/2008 | Steward et al. |
| 2008/0161543 | A1 | 7/2008 | Steward et al. |

FOREIGN PATENT DOCUMENTS

| WO | WO 94/21300 | 9/1994 |
| WO | WO 01/07072 | 2/2001 |
| WO | WO 01/94411 | 12/2001 |
| WO | WO 2004/024909 | 3/2004 |
| WO | WO 2005/023309 | 3/2005 |
| WO | WO 2006/027207 | 3/2006 |
| WO | WO 2006/059093 | 6/2006 |
| WO | WO 2006/059105 | 6/2006 |
| WO | WO2006/059113 | 6/2006 |

OTHER PUBLICATIONS

Tsui, J.K., *Botulinum Toxin as a Therapeutic Agent*, Pharmacol. Ther. 72(1):13-24 (1996).
Trejo, J., *Protease-Activated Receptors: New Concepts in Regulation of G Protein-Coupled Receptor Signaling and Trafficking*, J. Pharmacol. Exp. Ther. 307(2): 437-442 (2003).
Scarborough, R.M., *Protease-Activated Receptor-2 Antagonists and Agonists*, Curr. Med. Chem. Cardiovasc. Hematol. Agents 1(1): 73-82 (2003).
Pastan, I., FitzGerald, D., *Pseudomonas Exotoxin: Chimeric Toxins*, J. Biol. Chem. 264(26): 15157-15160 (1989).
Ossovskaya, V.S., Bennett, N.W., *Protease-Activated Receptors: Contribution to Physiology and Disease*, Physiol. Rev. 84(2): 579-621 (2004).
O'Brien, P.J. et al., *Protease Activated Receptors: Theme and Variations*, Oncogene 20(13): 1570-1581 (2001).
MacFarlane, S.R. et al., *Protease-Activated Receptors*, Pharmacol. Rev. 53(2): 245-282 (2001).
Hollenberg, M.D., Compton, S.J., *International Union of Pharmacology. XXVIII. Proteinase-Activated Receptors*, Pharmacol. Rev. 54(2): 203-217 (2002).

(Continued)

*Primary Examiner*—Chih-Min Kam
(74) *Attorney, Agent, or Firm*—Kenton Abel; Debra Condino; Dean Stathakis

(57) ABSTRACT

The specification discloses modified Clostridial toxins comprising a PAR ligand domain, a Clostridial toxin enzymatic domain, a Clostridial toxin translocation domain and a Clostridial toxin binding domain; polynucleotide molecules encoding modified Clostridial toxins comprising a PAR ligand domain, a Clostridial toxin enzymatic domain, a Clostridial toxin translocation domain and a Clostridial toxin binding domain; and method of producing modified Clostridial toxins comprising a PAR ligand domain, a Clostridial toxin enzymatic domain, a Clostridial toxin translocation domain and a Clostridial toxin binding domain.

29 Claims, 14 Drawing Sheets

OTHER PUBLICATIONS

Hirano, K., Kanaide, H., *Role of Protease-Activated Receptors in The Vascular System*, J. Atheroscler. Thromb. 10(4): 211-225 (2003).

Gaborik Z., Hunyady, L., *Intracellular Trafficking of Hormone Receptors*, Trends Endocrinol. Metab. 15(6): 286-293 (2004).

Faruqi, T.R. et al., *Structure-Function Analysis of Protease-Activated Receptor 4 Tethered Ligand Peptides. Determinants of Specificity and Utility in Assays of Receptor Function*, J. Biol. Chem. 275(26): 19728-19734 (2000).

Chackalamannil, S., *G-protein Coupled Receptor Antagonists-1: Protease Activated Receptor-1 (PAR-1) Antagonists as Novel Cardiovascular Therapeutic Agents*, Curr. Top. Med. Chem. 3(10): 1115-1123 (2003).

Cottrell, G.S. et al., *Protease-Activated Receptor 2: Activation, Signalling and Function*, Biochem. Soc. Trans. 31(6):1191-1197 (2003).

Cottrell, T.R. et al., Protease-Activated Receptors: *The Role of Cell-Surface Proteolysis in Signalling*, Essays Biochem. 38:169-183 (2002).

Coughlin, S.R., *Thrombin Signalling and Protease-Activated Receptors*, Nature 407(6801): 258-264 (2000).

Derian, C.K. et al., *Therapeutic Potential of Protease-Activated Receptor-1 Antagonists*, Expert Opin. Investig. Drugs 12(2): 209-221 (2003).

Coelho, A-M et al., *Proteinase-Activated Receptor-2: Physiological and Pathophysiological Roles*, Curr. Med. Chem. Cardiovasc. Hematol. Agents 1(1): 61-72 (2003).

Herreros et al, "C-Terminal Half of Tetanus Toxin Fragment C is Sufficient for Neuronal Binding and Interaction with a Putative Protein Receptor", Biochemical Journal, vol. 347, No. Part 1, pp. 199-204, Apr. 1, 2001.

Rummel et al, "The Hcc-domain of botulinum neurotoxins A and B exhibits a singular ganglioside binding site displaying serotype specific carbohydrate interation", Molecular Microbiology, pp. 631-643, Dec. 15, 2003.

Halpern et al, "Characterization of the receptor-binding domain of tetanus toxin", Journal of Biological Chemistry, pp. 11188-11192, May 25, 1993.

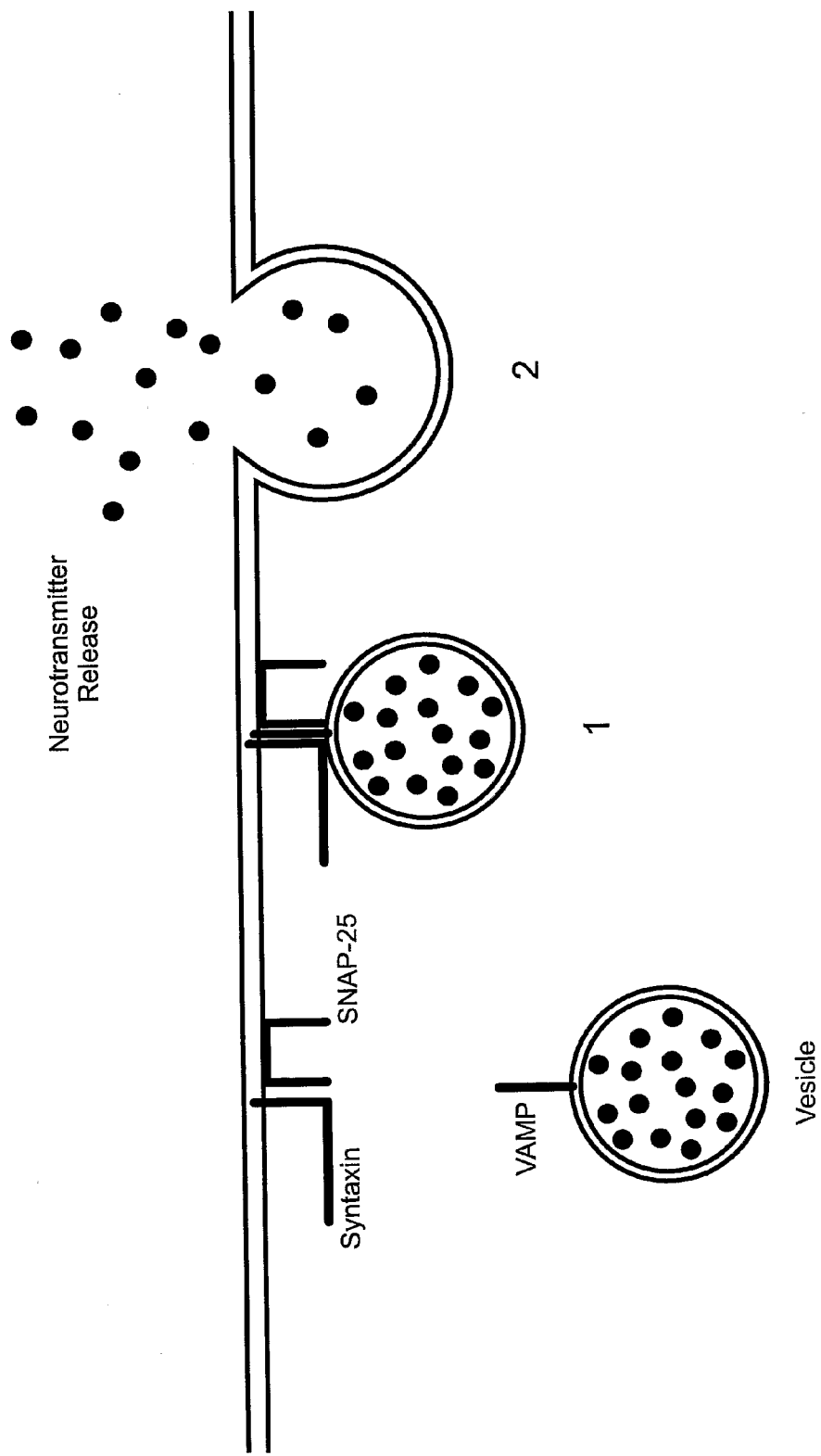

BoNT/A-TD-PAR1Tb pET29b/
BoNT/A-TD-PAR1Tb
9.5 kb

PAR1-LD
Thrombin
ED
TD
BD
Trypsin
6xHis
T7 TT
P_T7
f1 origin
lacI
pBR322 ori
Kanamycin

FIG. 9.

BoNT/A-BD-PAR1Tb pET29b/
BoNT/A-BD-PAR1Tb
9.5 kb

PAR1-LD
Thrombin
ED
BD
TD
Trypsin
6xHis
T7 TT
f1 origin
Kanamycin
pBR322 ori
lacI
P$_{T7}$

FIG. 10.

BoNT/A-ED-PAR1Tb pPICZ A/ BoNT/A-ED-PAR1Tb
7.3 kb

- PAR1-LD
- Thrombin
- ED
- TD
- BD
- c-myc
- 6xHis
- AOX1 TT
- Zeocin™
- pUC ori
- P$_{AOX1}$

FIG. 11.

BoNT/A-ED-PAR1Tb pBACgus/BoNT/A-ED-PAR1Tb
11.8 kb

Labels around plasmid: PAR1-LD, Thrombin, ED, TD, BD, Thrombin, 6xHis, pUC ori, Ampicillin, f1 ori, gus, P_PH, gp64

FIG. 12.

BoNT/A-ED-PAR1Tb pSecTag2/
BoNT/A-ED-PAR1Tb
9.2 kb

Labels around plasmid: PAR1-LD, Thrombin, ED, TD, BD, c-myc, 6xHis, BGH pA, f1 ori, P_SV40, Zeocin, pUC ori, Ampicillin, P_CMV, IgK

DEGRADABLE CLOSTRIDIAL TOXINS

This is a national stage application under 35 U.S.C. §371 of PCT patent application PCT/US2005/031613, filed on Sep. 1, 2005 which claims the benefit of U.S. provisional patent application Ser. No. 60/651,494 filed Sep. 1, 2004, which was converted on Jul. 5, 2005 from U.S. nonprovisional patent application Ser. No. 10/931,719 filed Sep. 1, 2004, each of which is hereby incorporated by reference in its entirety.

All of the patents and publications cited in this application are hereby incorporated by reference in their entirety.

The ability of Clostridial toxins, such as, e.g., Botulinum neurotoxins (BoNTs), BoNT/A, BoNT/B, BoNT/C1, BoNT/D, BoNT/E, BoNT/F and BoNT/G, and Tetanus neurotoxin (TeNT), to inhibit neuronal transmission are being exploited in a wide variety of therapeutic and cosmetic applications, see e.g., William J. Lipham, COSMETIC AND CLINICAL APPLICATIONS OF BOTULINUM TOXIN (Slack, Inc., 2004). As an example, BOTOX® is currently approved in one or more countries for the following indications: achalasia, adult spasticity, anal fissure, back pain, blepharospasm, bruxism, cervical dystonia, essential tremor, glabellar lines or hyperkinetic facial lines, headache, hemifacial spasm, hyperactivity of bladder, hyperhidrosis, juvenile cerebral palsy, multiple sclerosis, myoclonic disorders, nasal labial lines, spasmodic dysphonia, strabismus and VII nerve disorder. In addition, Clostridial toxin therapies are proposed for treating neuromuscular disorders, see e.g., Kei Roger Aoki et al., Method for Treating Neuromuscular Disorders and Conditions with Botulinum Toxin Types A and B, U.S. Pat. No. 6,872,397 (Mar. 29, 2005); Rhett M. Schiffman, Methods for Treating Uterine Disorders, U.S. Patent Publication No. 2004/0175399 (Sep. 9, 2004); Richard L. Barron, Methods for Treating Ulcers and Gastroesophageal Reflux Disease, U.S. Patent Publication No. 2004/0086531 (May 7, 2004); and Kei Roger Aoki, et al., Method for Treating Dystonia with Botulinum Toxin C to G, U.S. Pat. No. 6,319,505 (Nov. 20, 2001); eye disorders, see e.g., Eric R. First, Methods and Compositions for Treating Eye Disorders, U.S. Patent Publication No. 2004/0234532 (Nov. 25, 2004); Kei Roger Aoki et al., Botulinum Toxin Treatment for Blepharospasm, U.S. Patent Publication No. 2004/0151740 (Aug. 5, 2004); and Kei Roger Aoki et al., Botulinum Toxin Treatment for Strabismus, U.S. Patent Publication No. 2004/0126396 (Jul. 1, 2004); pain, see e.g., Kei Roger Aoki et al., Pain Treatment by Peripheral Administration of a Neurotoxin, U.S. Pat. No. 6,869,610 (Mar. 22, 2005); Stephen Donovan, Clostridial Toxin Derivatives and Methods to Treat Pain, U.S. Pat. No. 6,641,820 (Nov. 4, 2003); Kei Roger Aoki, et al., Method for Treating Pain by Peripheral Administration of a Neurotoxin, U.S. Pat. No. 6,464,986 (Oct. 15, 2002); Kei Roger Aoki and Minglei Cui, Methods for Treating Pain, U.S. Pat. No. 6,113,915 (Sep. 5, 2000); Martin A. Voet, Methods for Treating Fibromyalgia, U.S. Pat. No. 6,623,742 (Sep. 23, 2003); Martin A. Voet, Botulinum Toxin Therapy for Fibromyalgia, U.S. Patent Publication No. 2004/0062776 (Apr. 1, 2004); and Kei Roger Aoki et al., Botulinum Toxin Therapy for Lower Back Pain, U.S. Patent Publication No. 2004/0037852 (Feb. 26, 2004); muscle injuries, see e.g., Gregory F. Brooks, Methods for Treating Muscle Injuries, U.S. Pat. No. 6,423,319 (Jul. 23, 2002); headache, see e.g., Martin Voet, Methods for Treating Sinus Headache, U.S. Pat. No. 6,838,434 (Jan. 4, 2005); Kei Roger Aoki et al., Methods for Treating Tension Headache, U.S. Pat. No. 6,776,992 (Aug. 17, 2004); and Kei Roger Aoki et al., Method for Treating Headache, U.S. Pat. No. 6,458,365 (Oct. 1, 2002); William J. Binder, Method for Reduction of Migraine Headache Pain, U.S. Pat. No. 5,714,469 (Feb. 3, 1998); cardiovascular diseases, see e.g., Gregory F. Brooks and Stephen Donovan, Methods for Treating Cardiovascular Diseases with Botulinum Toxin, U.S. Pat. No. 6,767,544 (Jul. 27, 2004); neurological disorders, see e.g., Stephen Donovan, Parkinson's Disease Treatment, U.S. Pat. No. 6,620,415 (Sep. 16, 2003); and Stephen Donovan, Method for Treating Parkinson's Disease with a Botulinum Toxin, U.S. Pat. No. 6,306,403 (Oct. 23, 2001); neuropsychiatric disorders, see e.g., Stephen Donovan, Botulinum Toxin Therapy for Neuropsychiatric Disorders, U.S. Patent Publication No. 2004/0180061 (Sep. 16, 2004); and Steven Donovan, Therapeutic Treatments for Neuropsychiatric Disorders, U.S. Patent Publication No. 2003/0211121 (Nov. 13, 2003); endocrine disorders, see e.g., Stephen Donovan, Method for Treating Endocrine Disorders, U.S. Pat. No. 6,827,931 (Dec. 7, 2004); Stephen Donovan, Method for Treating Thyroid Disorders with a Botulinum Toxin, U.S. Pat. No. 6,740,321 (May 25, 2004); Kei Roger Aoki et al., Method for Treating a Cholinergic Influenced Sweat Gland, U.S. Pat. No. 6,683,049 (Jan. 27, 2004); Stephen Donovan, Neurotoxin Therapy for Diabetes, U.S. Pat. No. 6,416,765 (Jul. 9, 2002); Stephen Donovan, Methods for Treating Diabetes, U.S. Pat. No. 6,337,075 (Jan. 8, 2002); Stephen Donovan, Method for Treating a Pancreatic Disorder with a Neurotoxin, U.S. Pat. No. 6,261,572 (Jul. 17, 2001); Stephen Donovan, Methods for Treating Pancreatic Disorders, U.S. Pat. No. 6,143,306 (Nov. 7, 2000); cancers, see e.g., Stephen Donovan, Methods for Treating Bone Tumors, U.S. Pat. No. 6,565,870 (May 20, 2003); Stephen Donovan, Method for Treating Cancer with a Neurotoxin to Improve Patient Function, U.S. Pat. No. 6,368,605 (Apr. 9, 2002); Stephen Donovan, Method for Treating Cancer with a Neurotoxin, U.S. Pat. No. 6,139,845 (Oct. 31, 2000); and Mitchell F. Brin and Stephen Donovan, Methods for Treating Diverse Cancers, U.S. Patent Publication No. 2005/0031648 (Feb. 10, 2005); otic disorders, see e.g., Stephen Donovan, Neurotoxin Therapy for Inner Ear Disorders, U.S. Pat. No. 6,358,926 (Mar. 19, 2002); and Stephen Donovan, Method for Treating Otic Disorders, U.S. Pat. No. 6,265,379 (Jul. 24, 2001); autonomic disorders, see, e.g., Pankai J. Pasricha and Anthony N. Kalloo, Method for Treating Gastrointestinal Muscle Disorders and Other Smooth Muscle Dysfunction, U.S. Pat. No. 5,437,291 (Aug. 1, 1995); as well as other disorders, see e.g., William J. Binder, Method for Treatment of Skin Lesions Associated with Cutaneous Cell-proliferative Disorders, U.S. Pat. No. 5,670,484 (Sep. 23, 1997); Eric R. First, Application of Botulinum Toxin to the Management of Neurogenic Inflammatory Disorders, U.S. Pat. No. 6,063,768 (May 16, 2000); Marvin Schwartz and Brian J. Freund, Method to Reduce Hair Loss and Stimulate Hair Growth, U.S. Pat. No. 6,299,893 (Oct. 9, 2001); Jean D. A. Carruthers and Alastair Carruthers, Cosmetic Use of Botulinum Toxin for Treatment of Downturned Mouth, U.S. Pat. No. 6,358,917 (Mar. 19, 2002); Stephen Donovan, Use of a Clostridial Toxin to Reduce Appetite, U.S. Patent Publication No. 2004/40253274 (Dec. 16, 2004); and Howard I. Katz and Andrew M. Blumenfeld, Botulinum Toxin Dental Therapies and Procedures, U.S. Patent Publication No. 2004/0115139 (Jun. 17, 2004); Kei Roger Aoki, et al., Treatment of Neuromuscular Disorders and Conditions with Different Botulinum, U.S. Patent Publication No. 2002/0010138 (Jan. 24, 2002); and Kei Roger Aoki, et al., Use of Botulinum Toxins for Treating Various Disorders and Conditions and Associated Pain, U.S. Patent Publication No. 2004/0013692 (Jan. 22, 2004). In addition, the expected use of Clostridial toxins, such as, e.g., BoNTs and TeNT, in therapeutic and cosmetic treatments of humans and other mammals is anticipated to expand to an ever widening range of diseases and ailments that can benefit from the properties of these toxins.

Clostridial toxin therapies are successfully used for many indications. Generally, administration of a Clostridial toxin is well tolerated. However, toxin administration in some applications can be challenging because of the larger doses required to achieve a beneficial effect. Larger doses can increase the likelihood that the toxin may move through the interstitial fluids and the circulatory systems, such as, e.g., the cardiovascular system and the lymphatic system, of the body, resulting in the undesirable dispersal of the toxin to areas not targeted for toxin treatment. Such dispersal can lead to undesirable side effects, such as, e.g., inhibition of neurotransmitter release in neurons not targeted for treatment or paralysis of a muscle not targeted for treatment. For example, a patient administered a therapeutically effective amount of a BoNT/A treatment into the neck muscles for torticollis may develop dysphagia because of dispersal of the toxin into the oropharynx. Thus, there remains a need for improved Clostridial toxins that are effective at the site of treatment, but have negligible to minimal effects in areas not targeted for a toxin treatment.

The growing clinical, therapeutic and cosmetic use of Clostridial toxins in therapies requiring larger doses necessitates the pharmaceutical industry to develop modified Clostridial toxins that are effective at the target site of the application, but reduce or prevent the undesirable side-effects associated with the dispersal of the toxins to an unwanted location or locations. The present invention provides novel Clostridial toxins that reduce or prevent unwanted side-effects associated with toxin dispersal into non-targeted areas. These and related advantages are useful for various clinical, therapeutic and cosmetic applications, such as, e.g., the treatment of neuromuscular disorders, neuropathic disorders, eye disorders, pain, muscle injuries, headache, cardiovascular diseases, neuropsychiatric disorders, endocrine disorders, cancers, otic disorders and hyperkinetic facial lines, as well as, other disorders where a Clostridial toxin administration to a mammal can produce a beneficial effect.

BRIEF DESCRIPTION OF THE DRAWINGS

FIG. 3 shows a schematic of the current paradigm of neurotransmifter release and Clostridial toxin intoxication in a central and peripheral neuron. FIG. 3a shows a schematic for the neurotransmitter release mechanism of a central and peripheral neuron. The release process can be described as comprising two steps: 1) vesicle docking, where the vesicle-bound SNARE protein of a vesicle containing neurotransmitter molecules associates with the membrane-bound SNARE proteins located at the plasma membrane; and 2) neurotransmitter release, where the vesicle fuses with the plasma membrane and the neurotransmitter molecules are exocytosed.

FIG. 4 shows modified Clostridial toxins with a PAR ligand domain located at the amino terminus of the enzymatic domain.

FIG. 5 shows modified Clostridial toxins with a PAR ligand domain located at the amino terminus of the translocation domain.

FIG. 6 depicts the single polypeptide form of a Clostridial toxin with an amino to carboxyl linear organization comprising an enzymatic domain, a PAR ligand domain, a binding domain and a translocation domain, with the di-chain loop region depicted by the double SS bracket and the resulting di-chain form after di-chain loop cleavage. In this example, a masked PAR ligand domain is located at the amino terminus of the binding domain and a proteolytic cleavage site (P1) is located in front of the PAR ligand binding domain. Upon proteolytic cleavage with a P1 protease, the PAR ligand domain becomes unmasked. P1 is also the protease cleavage site used to convert the single chain form of the toxin to the di-chain form. P1 can be a PAR endogenous protease cleavage site or an exogenous protease cleavage site.

FIG. 7 shows a plasmid map of prokaryotic expression construct pET29b/BoNT/A-ED-PAR1Tb comprising a polynucleotide molecule of SEQ ID NO: 136 encoding a modified BoNT/A of SEQ ID NO: 85, operably-linked to a carboxyl-terminal polyhistidine binding polypeptide. A Trypsin protease cleavage site is operably-linked between the polyhistidine binding polypeptide and the modified BoNT/A. Abbreviations are as follows: $P_{T7}$, a bacteriophage T7 promoter region; Thrombin, a polynucleotide molecule encoding a PAR1 Thrombin cleavage site; PAR1-LD, a polynucleotide molecule encoding a PAR1 ligand domain; ED, a polynucleotide molecule encoding a BoNT/A enzymatic domain; TD, a polynucleotide molecule encoding a BoNT/A translocation domain; BD, a polynucleotide molecule encoding a BoNT/A binding domain; Trypsin, a polynucleotide molecule encoding Trypsin cleavage site; 6×His, a polynucleotide molecule encoding a polyhistidine binding polypeptide; T7 TT, a bacteriophage T7 transcription termination region; f1 origin, a bacteriophage f1 origin of replication; Kanamycin, a polynucleotide molecule encoding an aminophosphotransferase that confers Kanamycin resistance; pBR322 ori, a pBR322 origin of plasmid replication region; lacI, a polynucleotide molecule encoding a lactose I.

FIG. 8 shows a plasmid map of prokaryotic expression construct pET29b/BoNT/A-TD-PAR1Tb comprising a polynucleotide molecule of SEQ ID NO: 144 encoding a modified BoNT/A of SEQ ID NO: 93, operably-linked to a carboxyl-terminal polyhistidine binding polypeptide. A Trypsin protease cleavage site is operably-linked between the polyhistidine binding polypeptide and the modified BoNT/A. Abbreviations are as follows: $P_{T7}$, a bacteriophage T7 promoter region; ED, a polynucleotide molecule encoding a BoNT/A enzymatic domain; Thrombin, a polynucleotide molecule encoding a PAR1 Thrombin cleavage site; PAR1-LD, a polynucleotide molecule encoding a PAR1 ligand domain; TD, a polynucleotide molecule encoding a BoNT/A translocation domain; BD, a polynucleotide molecule encoding a BoNT/A binding domain; Trypsin, a polynucleotide molecule encoding Trypsin cleavage site; 6×His, a polynucleotide molecule encoding a polyhistidine binding polypeptide; T7 TT, a bacteriophage T7 transcription termination region; f1 origin, a bacteriophage f1 origin of replication; Kanamycin, a polynucleotide molecule encoding an aminophosphotransferase that confers Kanamycin resistance; pBR322 ori, a pBR322 origin of plasmid replication region; lacI, a polynucleotide molecule encoding a lactose I.

FIG. 9 shows a plasmid map of prokaryotic expression construct pET29b/BoNT/A-BD-PAR1Tb comprising a polynucleotide molecule of SEQ ID NO: 152 encoding a modified BoNT/A of SEQ ID NO: 101, operably-linked to a carboxyl-terminal polyhistidine binding polypeptide. A Trypsin protease cleavage site is operably-linked between the polyhistidine binding polypeptide and the modified BoNT/A. Abbreviations are as follows: $P_{T7}$, a bacteriophage T7 promoter region; Thrombin, a polynucleotide molecule encoding a PAR1 Thrombin cleavage site; PAR1-LD, a polynucleotide molecule encoding a PAR1 ligand domain; ED, a polynucleotide molecule encoding a BoNT/A enzymatic domain; TD, a polynucleotide molecule encoding a BoNT/A translocation domain; BD, a polynucleotide molecule encoding a BoNT/A binding domain; Trypsin, a polynucleotide molecule encoding Trypsin cleavage site; 6×His, a polynucleotide molecule encoding a polyhistidine binding polypeptide; T7 TT, a bacteriophage T7 transcription termination region; f1 origin, a bacteriophage f1 origin of replication; Kanamycin, a polynucleotide molecule encoding an aminophosphotransferase that confers Kanamycin resistance; pBR322 ori, a pBR322 origin of plasmid replication region; lacI, a polynucleotide molecule encoding a lactose I.

FIG. 10 shows a plasmid map of yeast expression construct pPICZ A/BoNT/A-ED-PAR1Tb comprising a polynucleotide molecule of SEQ ID NO: 136 encoding a modified BoNT/A of SEQ ID NO: 85, operably-linked to carboxyl-terminal c-myc and polyhistidine binding polypeptides. Abbreviations are as follows: $P_{AOX1}$, an aldehyde oxidase 1 promoter region; Thrombin, a polynucleotide molecule encoding a PAR1 Thrombin cleavage site; PAR1-LD, a polynucleotide molecule encoding a PAR1 ligand domain; ED, a polynucleotide molecule encoding a BoNT/A enzymatic domain; TD, a polynucleotide molecule encoding a BoNT/A translocation domain; BD, a polynucleotide molecule encoding a BoNT/A binding domain; c-myc, a polynucleotide molecule encoding a c-myc binding polypeptide; 6×His, a polynucleotide molecule encoding a polyhistidine binding polypeptide; AOX1 TT, an aldehyde oxidase 1 transcription termination region; Zeocin™, a polynucleotide molecule encoding a Zeocin™ resistance polypeptide; pUC ori, a pUC origin of plasmid replication region.

FIG. 11 shows a plasmid map of baculovirus transfer construct pBACgus3/BoNT/A-ED-PAR1Tb comprising a polynucleotide molecule of SEQ ID NO: 136 encoding a modified BoNT/A of SEQ ID NO: 85, operably-linked to carboxyl-terminal polyhistidine binding polypeptide. A Thrombin protease cleavage site is operably-linked between the modified BoNT/A and the polyhistidine binding polypeptide. Abbreviations are as follows: $P_{PH}$, an polyhedrin promoter region; gp64, a polynucleotide molecule encoding a gp64 signal polypeptide; Thrombin, a polynucleotide molecule encoding a PAR1 Thrombin cleavage site; PAR1-LD, a polynucleotide molecule encoding a PAR1 ligand domain; ED, a polynucleotide molecule encoding a BoNT/A enzymatic domain; TD, a polynucleotide molecule encoding a BoNT/A translocation domain; BD, a polynucleotide molecule encoding a BoNT/A binding domain; Thrombin, a polynucleotide molecule encoding a Thrombin protease cleavage site; 6×His, a polynucleotide molecule encoding a polyhistidine binding polypeptide; pUC ori, a pUC origin of plasmid replication region; Ampicillin, a polynucleotide molecule encoding a β-lactamase that confers Ampicillin resistance; f1 ori, a bacteriophage f1 origin of replication; gus, a polynucleotide molecule encoding a β-glucuronidase.

FIG. 12 shows a plasmid map of mammalian expression construct pSecTag2/BoNT/A-ED-PAR1Tb comprising a polynucleotide molecule of SEQ ID NO: 136 encoding a modified BoNT/A of SEQ ID NO: 85, operably-linked to carboxyl-terminal c-myc and polyhistidine binding polypeptides. Abbreviations are as follows: PcMV, an cytomegalovirus promoter region; IgK, a polynucleotide molecule encoding an immunoglobulin K polypeptide; Thrombin, a polynucleotide molecule encoding a PAR1 Thrombin cleavage site; PAR1-LD, a polynucleotide molecule encoding a PAR1 ligand domain; ED, a polynucleotide molecule encoding a BoNT/A enzymatic domain; TD, a polynucleotide molecule encoding a BoNT/A translocation domain; BD, a polynucleotide molecule encoding a BoNT/A binding domain; c-myc, a polynucleotide molecule encoding a c-myc binding polypeptide; 6×His, a polynucleotide molecule encoding a polyhistidine binding polypeptide; BGH pA, a bovine growth hormone polyadenylation site; f1 ori, a bacteriophage f1 origin of replication; $P_{SV40}$, a simian virus 40 promoter region; Zeocin™, a region encoding an Zeocin™ resistance polypeptide; pUC ori, a pUC origin of plasmid replication region; Ampicillin, a polynucleotide molecule encoding a β-lactamase that confers Ampicillin resistance.

DETAILED DESCRIPTION

Figure 1:
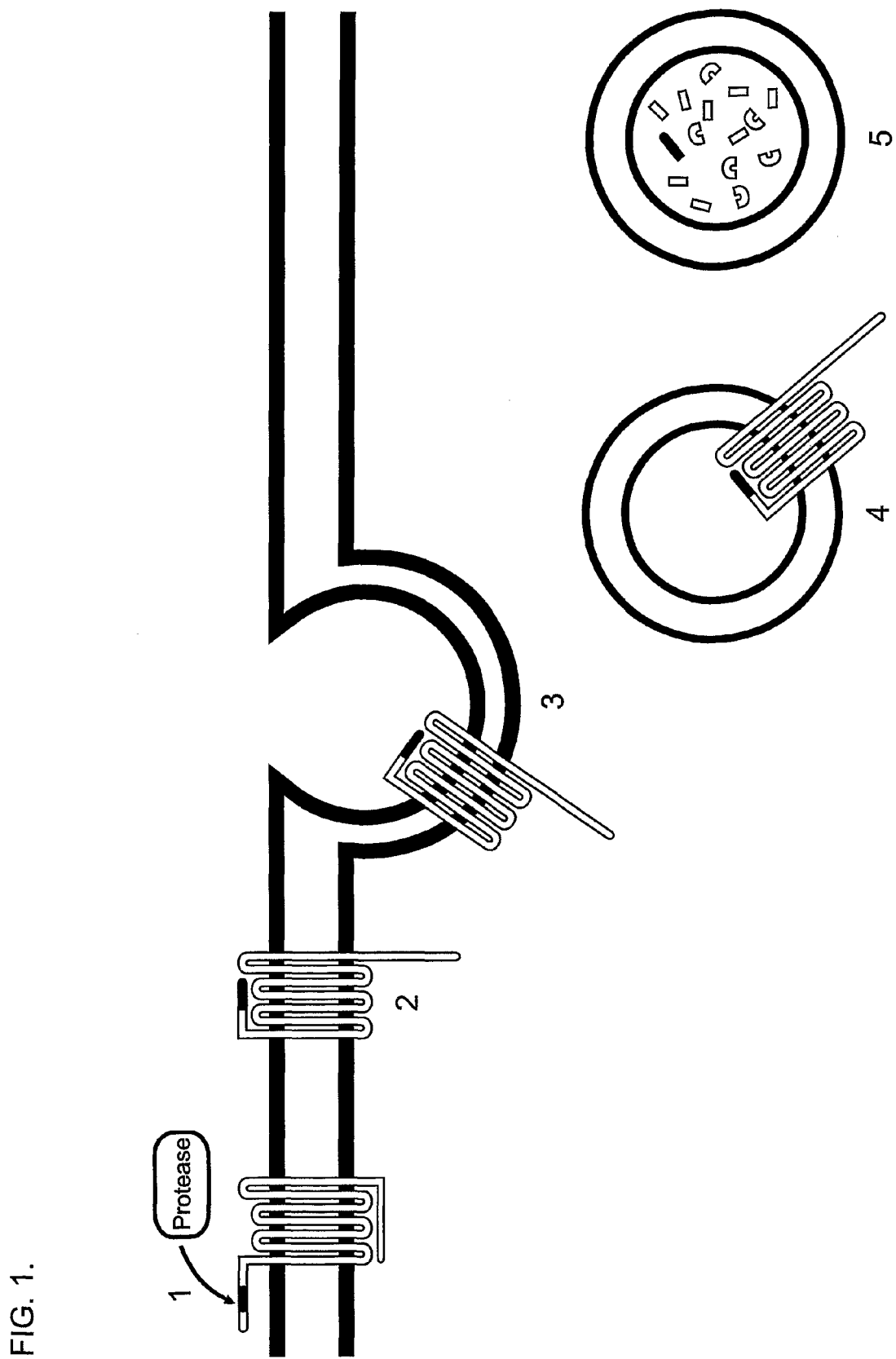
FIG. 1 shows that activated PARs are predominantly targeted toward lysosomes for degradation. PARs are activated by an irreversible mechanism, and once cleaved, most activated PARs are endocytosed and directed, by intracellular trafficking routes, to lysosomes for degradation. Step 1 illustrates cleavage of an inactivated PAR by a protease to unmask the tethered ligand (black box). Step 2 illustrates tethered ligand binding and conformational change of the activated PAR. Step 3 illustrates endocytosis of the activated PAR. Step 4 illustrates the early and late endosomal sorting of the internalized activated PAR that result in the trafficking of the receptor to a lysosome. Step 5 illustrates the degradation of the internalized activated PAR by proteases within the lysosome.

While all details of this process are not yet precisely known, protease-activated G protein-coupled receptor (PAR) signaling elicits responses according to the classic paradigm established for other GPCRs. Although the applicants have no wish to be limited by the following description, the overall signaling mechanism can be described as comprising at least four steps: 1) receptor activation where the protease agonist cleaves a specific site located at the extracellular amino-terminus of the receptor that generates a new amino acid terminus that that functions as a tethered ligand; 2) ligand binding where the unmasked tethered ligand binds to the ligand binding domain located in the second extracellular loop of the receptor resulting in a conformational change of the cleaved PAR that promotes intracellular interactions with heteromeric G proteins; 3) signal transduction where, in common with most GPCRs, the PAR-G protein complex signals through various Gq-, Gi- and Gβγ-mediated signaling pathways in a temporal and spatial manner; and 4) signal termination where receptor desensitization and receptor degradation stop the signaling of the activated complex (FIG. 1), see, e.g., Joann Trejo, *Protease-Activated Receptors: New Concepts in Regulation of G Protein-Coupled Receptor Signaling and Trafficking*, 307(2) J. Pharmacol. Exp. Ther. 437-442 (2003); and Valeria S. Ossovskaya and Nigel W. Bennett, *Protease-Activated Receptors: Contribution to Physiology and Disease*, 84(2) Physiol. Rev. 579-621 (2004).

Despite the irreversible mechanism of receptor activation, signaling initiated by activated PARs appears to be rapidly and efficiently terminated. Signal termination is especially important for regulating the magnitude, duration and fidelity of PAR-elicited cellular responses and appears to be governed by two processes. The first mechanism is receptor desensitization, where enzymatic phosphorylation of the activated PAR by G-protein Receptor Kinases (GRKs) and other kinases uncouple the activated receptor from its associated G proteins and signaling effectors. The second mechanism of PAR-initiated signal termination is receptor degradation, where proteolytic cleavage of the activated PAR by cell-surface proteases on the plasma membrane and by intracellular proteases within lysosomal vesicles destroys the activated receptors. Because of the irreversible nature of PAR activation, internalization of activated PARs and their subsequent sorting to lysosomes appears to be the dominant process for signal termination. Internalization of activated PARs contributes to signal termination both by removing activated receptors from G proteins and signaling effectors and by directing activated receptors to lysosomal vesicles where proteolytic degradation effectively inactivates the activated receptor. In addition to endocytosis of activated receptors, PARs also undergo constitutive endocytosis in the absence of proteolytic activation. Therefore, the unusual and irreversible mode of PAR activation has given rise to a very rapid and efficient means of terminating the signaling events elicited by activated PARs utilizing endocytosis and lysosomal degradation.

Figure 2:
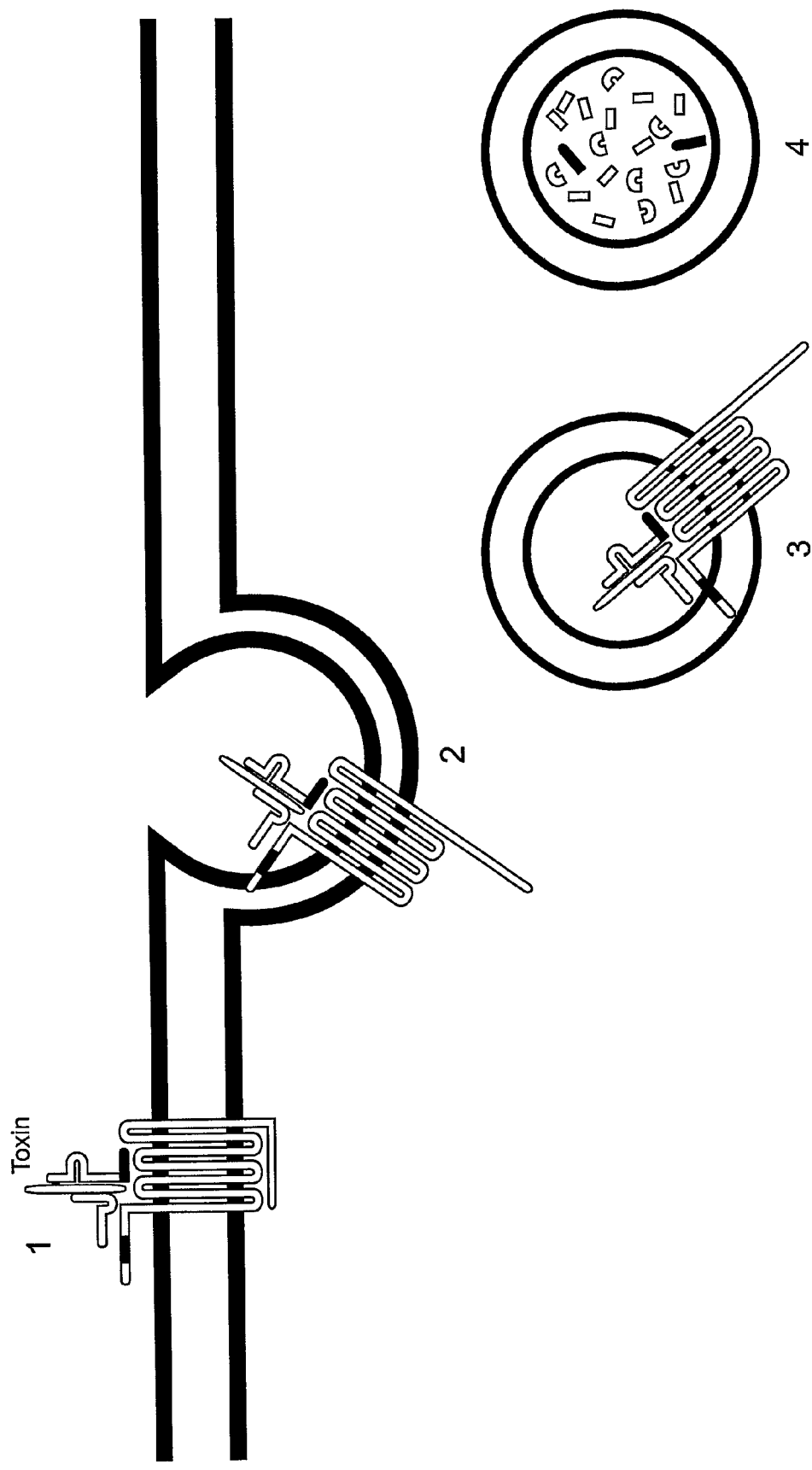
FIG. 2 shows modified Clostridial toxins comprising a tethered ligand are targeted toward lysosomes for degradation. Such modified toxins that diffuse into the circulatory system can bind to inactive PARs which triggers endocytosis and the directing of internalized toxins, by intracellular trafficking routes, to lysosomes for degradation. Step 1 illustrates the binding of the modified Clostridial toxin comprising a tethered ligand domain (black box) to a PAR. Step 2 illustrates endocytosis of the toxin-PAR complex. Step 3 illustrates the early and late endosomal sorting of the internalized toxin-PAR complex that result in the trafficking of the complex to a lysosome. Step 4 illustrates the degradation of the internalized toxin-PAR complex by proteases within the lysosome.

The present invention discloses modified Clostridial toxins that can be rapidly removed from the circulatory system by exploiting the processes involved in activated PAR signal termination. Clostridial toxins containing a PAR ligand domain can bind PARs, which initiates the internalization and degradation of such modified toxins. Many tissues of the cardiovascular system and lymphatic system comprise cells which express PARs. In situations where a modified Clostridial toxin comprising a PAR ligand domain has diffused into a circulatory system, this modified toxin can be effectively internalized by a PAR expressing cell and degraded by proteases within lysosomes (FIG. 2). Thus utilizing the processes involved in PAR-elicited signal termination will lessen or remove a Clostridial toxin from the circulatory system thereby reducing or preventing the undesirable side-effects associated with the diffusion of a Clostridial toxin to an unwanted location.

Aspects of the present invention provide modified Clostridial toxins comprising a PAR ligand domain; a Clostridial toxin enzymatic domain; a Clostridial toxin translocation domain; and a Clostridial toxin binding domain. It is envisioned that the location of the PAR ligand domain in the modified Clostridial toxins of the present specification is located at a free amino terminus, including, without limitation, at the amino terminus of the Clostridial toxin enzymatic domain; at the amino terminus of the Clostridial toxin translocation domain; and at the amino terminus of the Clostridial toxin binding domain. Thus, in embodiments, the modified Clostridial toxins comprise a PAR ligand domain; a Clostridial toxin enzymatic domain; a Clostridial toxin translocation domain; and a Clostridial toxin binding domain; wherein the PAR ligand domain is located at the amino terminus of the Clostridial toxin enzymatic domain. In other embodiments, the modified Clostridial toxins comprise a PAR ligand domain; a Clostridial toxin enzymatic domain; a Clostridial toxin translocation domain; and a Clostridial toxin binding domain; wherein the PAR ligand domain is located at the amino terminus of the Clostridial toxin translocation domain. In still other embodiments, the modified Clostridial toxins comprise a PAR ligand domain; a Clostridial toxin enzymatic domain; a Clostridial toxin translocation domain; and a Clostridial toxin binding domain; wherein the PAR ligand domain is located at the amino terminus of the Clostridial toxin binding domain.

Other aspects of the present invention provide polynucleotide molecules encoding modified Clostridial toxins comprising a PAR ligand domain; a Clostridial toxin enzymatic domain; a Clostridial toxin translocation domain; and a Clostridial toxin binding domain. It is envisioned that the location of the PAR ligand domain of the modified Clostridial toxins encoded by polynucleotide molecules of the present specification is located at a free amino terminus, including, without limitation, at the amino terminus of the Clostridial toxin enzymatic domain; at the amino terminus of the Clostridial toxin translocation domain; and at the amino terminus of the Clostridial toxin binding domain. Thus, in embodiments, the polynucleotide molecules encoded modified Clostridial toxins comprising a PAR ligand domain; a Clostridial toxin enzymatic domain; a Clostridial toxin translocation domain; and a Clostridial toxin binding domain; wherein the PAR ligand domain is located at the amino terminus of the Clostridial toxin enzymatic domain. In other embodiments, the polynucleotide molecules encoded modified Clostridial toxins comprising a PAR ligand domain; a Clostridial toxin enzymatic domain; a Clostridial toxin translocation domain; and a Clostridial toxin binding domain; wherein the PAR ligand domain is located at the amino terminus of the Clostridial toxin translocation domain. In still other embodiments, the polynucleotide molecules encoded modified Clostridial toxins comprising a PAR ligand domain; a Clostridial toxin enzymatic domain; a Clostridial toxin translocation domain; and a Clostridial toxin binding domain; wherein the PAR ligand domain is located at the amino terminus of the Clostridial toxin binding domain.

Other aspects of the present invention provide methods of producing a modified Clostridial toxin comprising a PAR ligand domain; a Clostridial toxin enzymatic domain; a Clostridial toxin translocation domain; and a Clostridial toxin binding domain, such method comprising the step of expressing in a cell a polynucleotide molecule encoding a modified Clostridial toxin comprising a PAR ligand domain; a Clostridial toxin enzymatic domain; a Clostridial toxin translocation domain; and a Clostridial toxin binding domain. Other aspects of the present invention provide methods of producing in a cell a modified Clostridial toxin comprising a PAR ligand domain; a Clostridial toxin enzymatic domain; a Clostridial toxin translocation domain; and a Clostridial toxin binding domain, such method comprising the steps of introducing in a cell an expression construct comprising a polynucleotide molecule encoding a modified Clostridial toxin comprising a PAR ligand domain; a Clostridial toxin enzymatic domain; a Clostridial toxin translocation domain; and a Clostridial toxin binding domain and expressing the expression construct in the cell.

Aspects of the present invention provide, in part, a Clostridial toxin. As used herein, the term "Clostridial toxin" means any polypeptide that can execute the overall cellular mechanism whereby a Clostridial toxin enters a neuron and inhibits neurotransmitter release and encompasses the binding of a Clostridial toxin to a low or high affinity receptor complex, the internalization of the toxin/receptor complex, the translocation of the Clostridial toxin light chain into the cytoplasm and the enzymatic modification of a Clostridial toxin substrate. Clostridia toxins produced by *Clostridium botulinum, Clostridium tetani, Clostridium baratii* and *Clostridium butyricum* are the most widely used in therapeutic and cosmetic treatments of humans and other mammals. Strains of *C. botulinum* produce seven antigenically-distinct types of Botulinum toxins (BoNTs), which have been identified by investigating botulism outbreaks in man (BoNT/A, /B, /E and /F), animals (BoNT/C1 and /D), or isolated from soil (BoNT/G). BoNTs possess approximately 35% amino acid identity with each other and share the same functional domain organization and overall structural architecture. It is recognized by those of skill in the art that within each type of Clostridial toxin there can be subtypes that differ somewhat in their amino acid sequence, and also in the nucleic acids encoding these proteins. For example, there are presently four BoNT/A subtypes, BoNT/A1, BoNT/A2, BoNT/A3 and BoNT/A4, with specific subtypes showing approximately 89% amino acid identity when compared to another BoNT/A subtype. While all seven BoNT serotypes have similar structure and pharmacological properties, each also displays heterogeneous bacteriological characteristics. In contrast, tetanus toxin (TeNT) is produced by a uniform group of *C. tetani*. Two other species of Clostridia, *C. baratii* and *C. butyricum*, also produce toxins similar to BoNT/F and BoNT/E, respectively.

Clostridial toxins are each translated as a single chain polypeptide of approximately 150 kDa that is subsequently cleaved by proteolytic scission within a disulfide loop by a naturally-occurring protease, such as, e.g., an endogenous Clostridial toxin protease or a naturally-occurring proteases produced in the environment. This posttranslational processing yields a di-chain molecule comprising an approximately 50 kDa light chain (LC) and an approximately 100 kDa heavy chain (HC) held together by a single disulfide bond and non-covalent interactions. Each mature di-chain molecule comprises three functionally distinct domains: 1) an enzymatic domain located in the LC that includes a metalloprotease region containing a zinc-dependent endopeptidase activity which specifically targets core components of the neurotransmitter release apparatus (Table 1); 2) a translocation domain contained within the amino-terminal half of the HC($H_N$) that facilitates release of the LC from intracellular vesicles into the cytoplasm of the target cell (Table 1); and 3) a binding domain found within the carboxyl-terminal half of the HC ($H_C$) that determines the binding activity and binding specificity of the toxin to the receptor complex located at the surface of the target cell (Table 1).

Figure 3B:
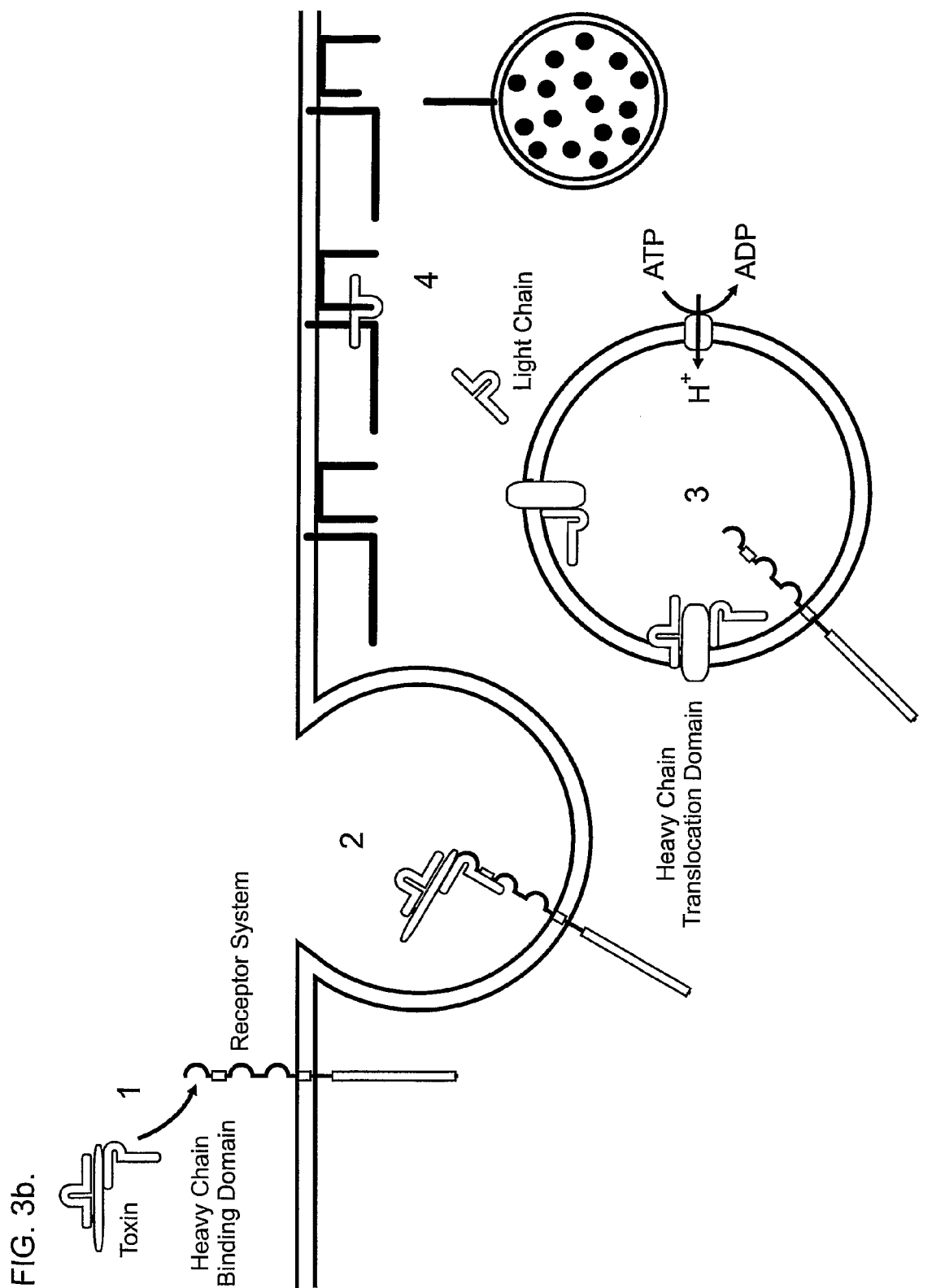
FIG. 3b shows a schematic of the intoxication mechanism for tetanus and botulinum toxin activity in a central and peripheral neuron. This intoxication process can be described as comprising four steps: 1) receptor binding, where a Clostridial toxin binds to a Clostridial receptor system and initiates the intoxication process; 2) complex internalization, where after toxin binding, a vesicle containing the toxin/receptor system complex is endocytosed into the cell; 3) light chain translocation, where multiple events are thought to occur, including, e.g., changes in the internal pH of the vesicle, formation of a channel pore comprising the $H_N$ domain of the Clostridial toxin heavy chain, separation of the Clostridial toxin light chain from the heavy chain, and release of the active light chain and 4) enzymatic target modification, where the activate light chain of Clostridial toxin proteolytically cleaves its target SNARE substrate, such as, e.g., SNAP-25, VAMP or Syntaxin, thereby preventing vesicle docking and neurotransmitter release.
Figure 4A:
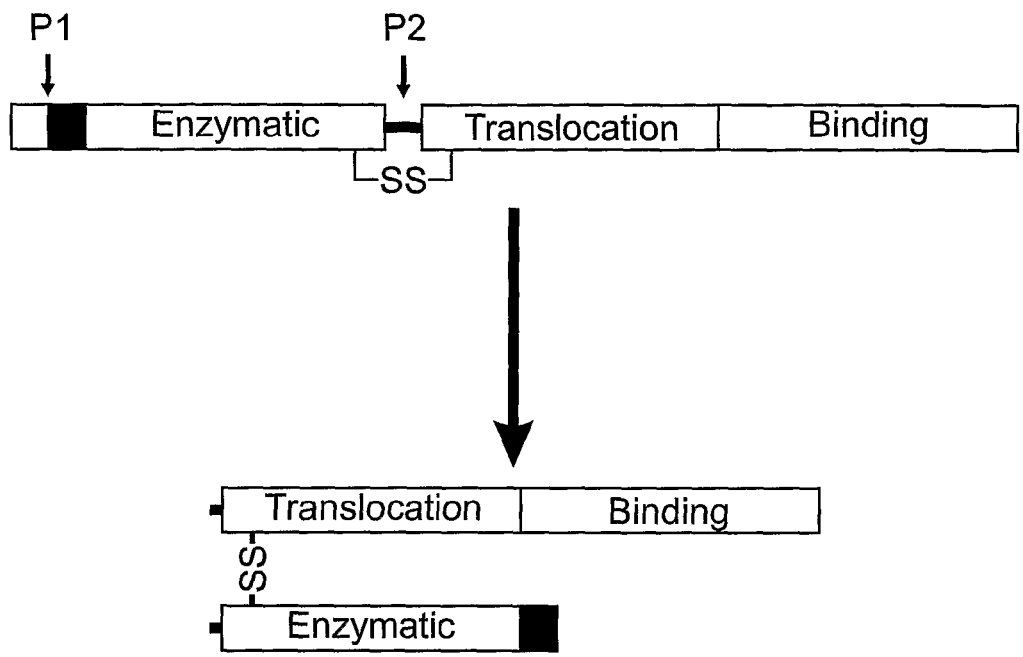
FIG. 4A depicts the single polypeptide form of a Clostridial toxin with an amino to carboxyl linear organization comprising a PAR ligand domain, an enzymatic domain, a translocation domain and a binding domain, with the di-chain loop region depicted by the double SS bracket and the resulting di-chain form after di-chain loop cleavage. In this example, a masked PAR ligand domain is located at the amino terminus of the enzymatic domain and a proteolytic cleavage site (P1) is located in front of the PAR ligand binding domain. Upon proteolytic cleavage with a P1 protease, the PAR ligand domain becomes unmasked. P2 is a protease cleavage site used to convert the single chain form of the toxin to the di-chain form. Both P1 and P2 can be a PAR endogenous protease cleavage site or an exogenous protease cleavage site and can be cleaved by the same protease or different proteases.
Figure 4B:
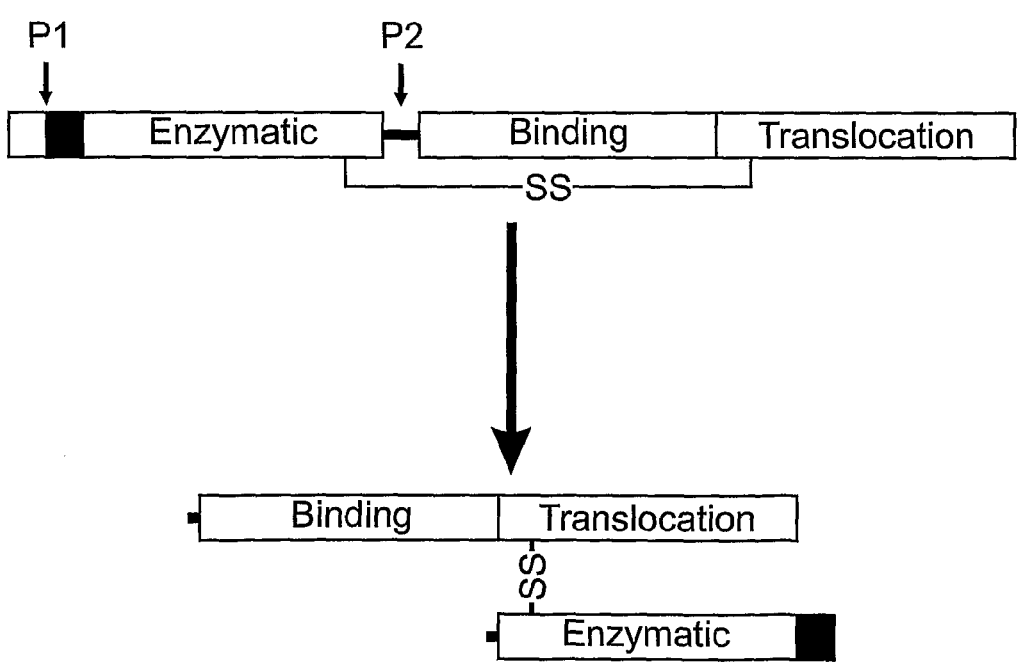
FIG. 4B depicts the single polypeptide form of a Clostridial toxin with an amino to carboxyl linear organization comprising a PAR ligand domain, an enzymatic domain, a binding domain and a translocation domain, with the di-chain loop region depicted by the double SS bracket. In this example, a masked PAR ligand domain is located at the amino terminus of the enzymatic domain and a proteolytic cleavage site (P1) is located in front of the PAR ligand binding domain. Upon proteolytic cleavage with a P1 protease, the PAR ligand domain becomes unmasked. P2 is a protease cleavage site used to convert the single chain form of the toxin to the di-chain form. Both P1 and P2 can be a PAR endogenous protease cleavage site or an exogenous protease cleavage site and can be cleaved by the same protease or different proteases.
Figure 4C:
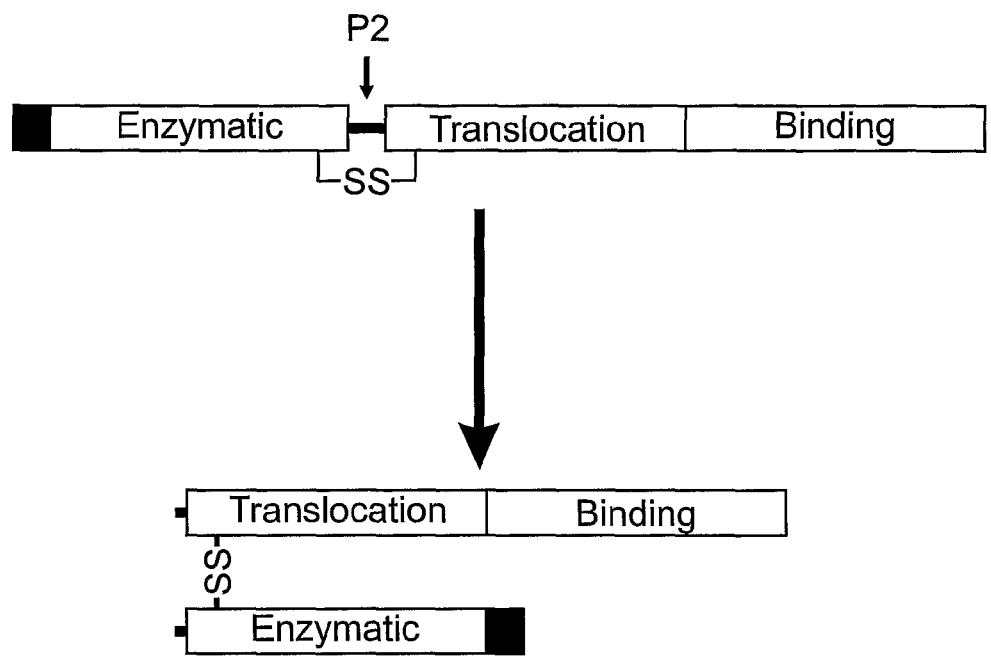
FIG. 4C depicts the single polypeptide form of a Clostridial toxin with an amino to carboxyl linear organization comprising a PAR ligand domain, an enzymatic domain, a translocation domain and a binding domain, with the di-chain loop region depicted by the double SS bracket. In this example, an unmasked PAR ligand domain is located at the amino terminus of the enzymatic domain. P2 is a protease cleavage site used to convert the single chain form of the toxin to the di-chain form and can be a PAR endogenous protease cleavage site or an exogenous protease cleavage site.
Figure 4D:
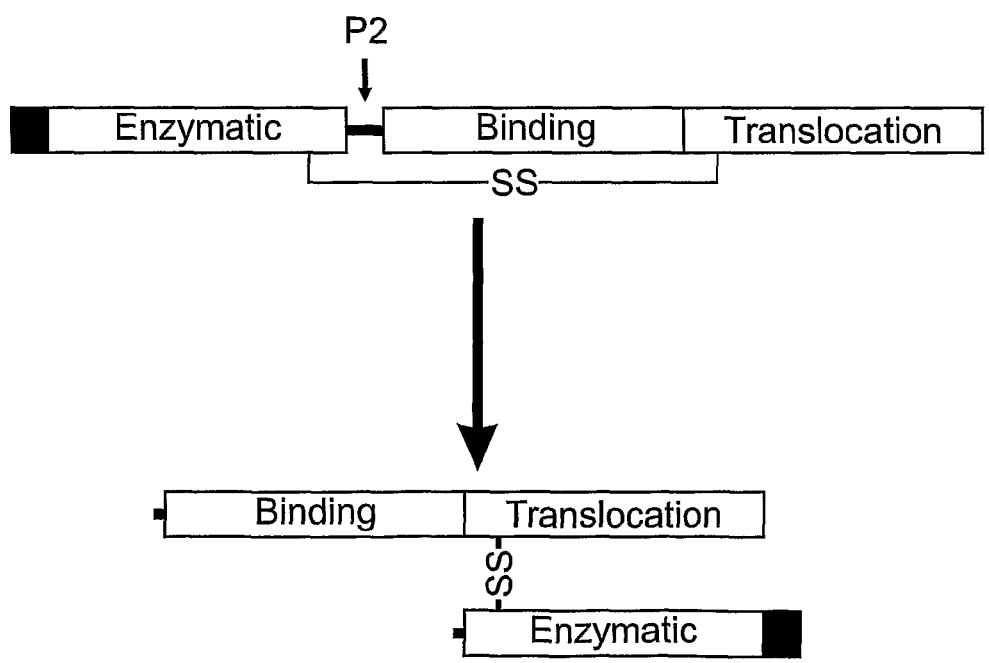
FIG. 4D depicts the single polypeptide form of a Clostridial toxin with an amino to carboxyl linear organization comprising a PAR ligand domain, an enzymatic domain, a binding domain and a translocation domain, with the di-chain loop region depicted by the double SS bracket. In this example, an unmasked PAR ligand domain is located at the amino terminus of the enzymatic domain. P2 is a protease cleavage site used to convert the single chain form of the toxin to the di-chain form and can be a PAR endogenous protease cleavage site or an exogenous protease cleavage site.
Figure 5A:
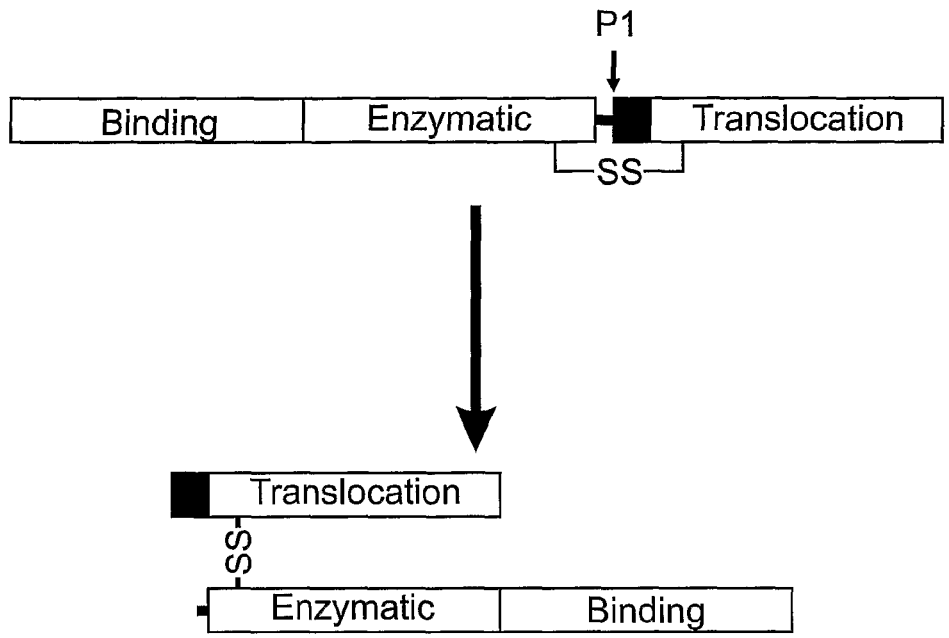
FIG. 5A depicts the single polypeptide form of a Clostridial toxin with an amino to carboxyl linear organization comprising a binding domain, an enzymatic domain, a PAR ligand domain and a translocation domain, with the di-chain loop region depicted by the double SS bracket and the resulting di-chain form after di-chain loop cleavage. In this example, a masked PAR ligand domain is located at the amino terminus of the translocation domain and a proteolytic cleavage site (P1) is located in front of the PAR ligand binding domain. Upon proteolytic cleavage with a P1 protease, the PAR ligand domain becomes unmasked. P1 is also the protease cleavage site used to convert the single chain form of the toxin to the di-chain form. P1 can be a PAR endogenous protease cleavage site or an exogenous protease cleavage site.
Figure 5B:
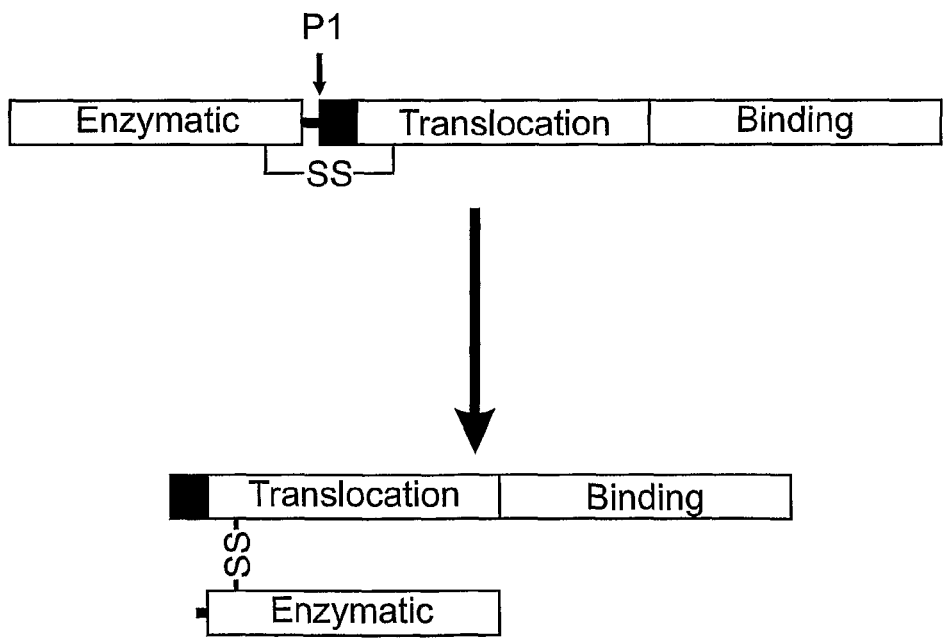
FIG. 5B depicts the single polypeptide form of a Clostridial toxin with an amino to carboxyl linear organization comprising an enzymatic domain, a PAR ligand domain, a translocation domain and a binding domain, with the di-chain loop region depicted by the double SS bracket. In this example, a masked PAR ligand domain is located at the amino terminus of the translocation domain and a proteolytic cleavage site (P1) is located in front of the PAR ligand binding domain. Upon proteolytic cleavage with a P1 protease, the PAR ligand domain becomes unmasked. P1 is also the protease cleavage site used to convert the single chain form of the toxin to the di-chain form. P1 can be a PAR endogenous protease cleavage site or an exogenous protease cleavage site.
Figure 6:
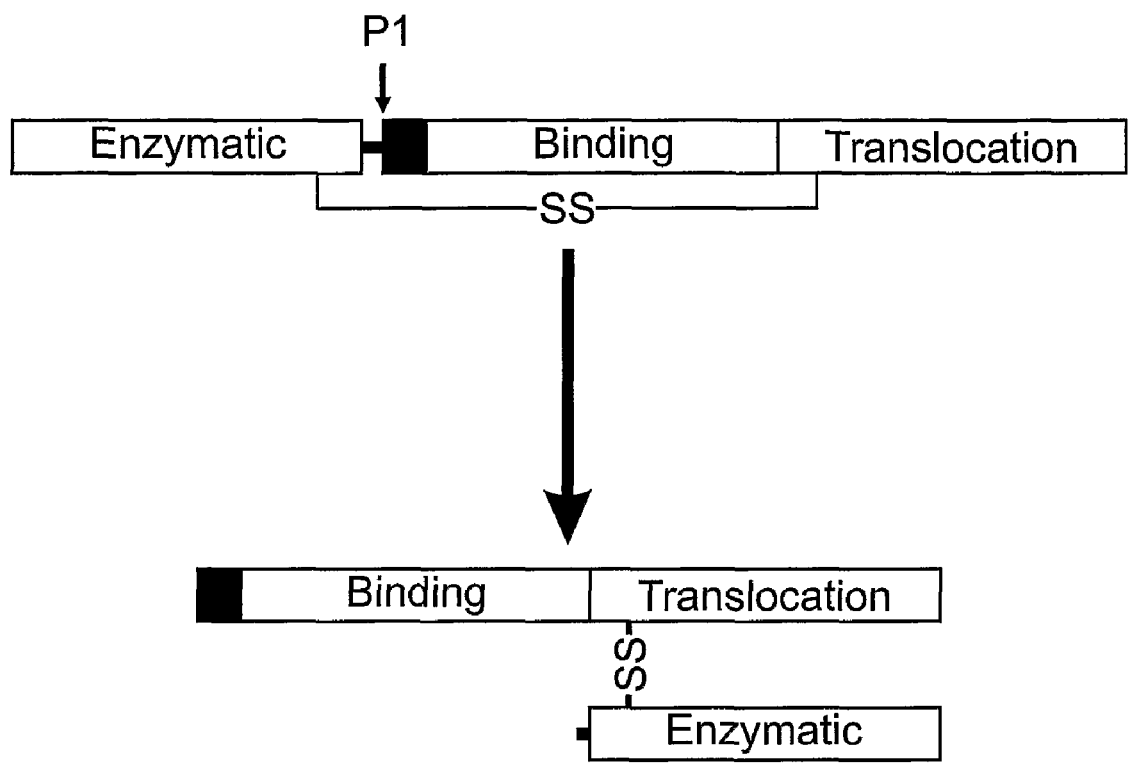
FIG. 6 shows modified Clostridial toxins with a PAR ligand domain located at the amino terminus of the binding domain.

The binding, translocation and enzymatic activity of these three functional domains are all necessary for toxicity. While all details of this process are not yet precisely known, the overall cellular intoxication mechanism whereby Clostridial toxins enter a neuron and inhibit neurotransmitter release is similar, regardless of type. Although the applicants have no wish to be limited by the following description, the intoxication mechanism can be described as comprising at least four steps: 1) receptor binding, 2) complex internalization, 3) light chain translocation, and 4) enzymatic target modification (see FIG. 3b). The process is initiated when the HC domain of a Clostridial toxin binds to a toxin-specific receptor complex located on the plasma membrane surface of a target cell. The binding specificity of a receptor complex is thought to be achieved, in part, by specific combinations of gangliosides and protein receptors that appear to distinctly comprise each Clostridial toxin receptor complex. Once bound, the toxin/receptor complexes are internalized by endocytosis and the internalized vesicles are sorted to specific intracellular routes. The translocation step appears to be triggered by the acidification of the vesicle compartment. This process seems to initiate two important pH-dependent structural rearrangements that increase hydrophobicity and promote formation di-chain form of the toxin. Once activated, light chain endopeptidase of the toxin is released from the intracellular vesicle into the cytosol where it specifically targets one of three known core components of the neurotransmitter release apparatus. These core proteins, vesicle-associated membrane protein (VAMP)/synaptobrevin, synaptosomal-associated protein of 25 kDa (SNAP-25) and Syntaxin, are necessary for synaptic vesicle docking and fusion at the nerve terminal and constitute members of the soluble N-ethylmaleimide-sensitive factor-attachment protein-receptor (SNARE) family. BoNT/A and BoNT/E cleave SNAP-25 in the carboxyl terminal region, releasing a nine or twenty six amino acid segment, respectively, and BoNT/C1 also cleaves SNAP 25 near the carboxyl terminus. The botulinum serotypes BoNT/B, BoNT/D, BoNT/F and BoNT/G, and tetanus toxin, act on the conserved central portion of VAMP, and release the amino terminal portion of VAMP into the cytosol. BoNT/C1 cleaves syntaxin at a single site near the cytosolic membrane surface. The selective proteolysis of synaptic SNAREs accounts for the block of neurotransmitter release caused by Clostridial toxins in vivo. The SNARE protein targets of Clostridial toxins are common to exocytosis in a variety of non-neuronal types; in these cells, as in neurons, light chain peptidase activity inhibits exocytosis, see, e.g., Yann Humeau et al., *How Botulinum and Tetanus Neurotoxins Block Neurotransmitter Release*, 82(5) Biochimie. 427-446 (2000); Kathryn Turton et al., *Botulinum and Tetanus Neurotoxins: Structure, Function and Therapeutic Utility*, 27(11) Trends Biochem. Sci. 552-558. (2002); Giovanna Lalli et al., *The Journey of Tetanus and Botulinum Neurotoxins in Neurons*, 11(9) Trends Microbiol. 431-437, (2003).

TABLE 1

Clostridial Toxin Reference Sequences and Regions

| Toxin | SEQ ID NO: | LC | $H_N$ | $H_C$ |
|---|---|---|---|---|
| BoNT/A | 1 | M1-K448 | A449-K871 | N872-L1296 |
| BoNT/B | 2 | M1-K441 | A442-S858 | E859-E1291 |
| BoNT/C1 | 3 | M1-K449 | T450-N866 | N867-E1291 |
| BoNT/D | 4 | M1-R445 | D446-N862 | S863-E1276 |
| BoNT/E | 5 | M1-R422 | K423-K845 | R846-K1252 |
| BoNT/F | 6 | M1-K439 | A440-K864 | K865-E1274 |
| BoNT/G | 7 | M1-K446 | S447-S863 | N864-E1297 |
| TeNT | 8 | M1-A457 | S458-V879 | I880-D1315 |

A Clostridial toxin includes, without limitation, naturally occurring Clostridial toxin variants, such as, e.g., Clostridial toxin isoforms and Clostridial toxin subtypes; non-naturally occurring Clostridial toxin variants, such as, e.g., conservative Clostridial toxin variants, non-conservative Clostridial toxin variants, Clostridial toxin chimeric variants and active Clostridial toxin fragments thereof, or any combination thereof. As used herein, the term "Clostridial toxin variant," whether naturally-occurring or non-naturally-occurring, means a Clostridial toxin that has at least one amino acid change from the corresponding region of the disclosed reference sequences (see Table 1) and can be described in percent identity to the corresponding region of that reference sequence. As non-limiting examples, a BoNT/A variant comprising amino acids 1-1296 of SEQ ID NO: 1 will have at least one amino acid difference, such as, e.g., an amino acid substitution, deletion or addition, as compared to the amino acid region 1-1296 of SEQ ID NO: 1; a BoNT/B variant comprising amino acids 1-1291 of SEQ ID NO: 2 will have at least one amino acid difference, such as, e.g., an amino acid substitution, deletion or addition, as compared to the amino acid region 1-1291 of SEQ ID NO: 2; a BoNT/C1 variant comprising amino acids 1-1291 of SEQ ID NO: 3 will have at least one amino acid difference, such as, e.g., an amino acid substitution, deletion or addition, as compared to the amino acid region 1-1291 of SEQ ID NO: 3; a BoNT/D variant comprising amino acids 1-1276 of SEQ ID NO: 4 will have at least one amino acid difference, such as, e.g., an amino acid substitution, deletion or addition, as compared to the amino acid region 1-1276 of SEQ ID NO: 4; a BoNT/E variant comprising amino acids 1-1252 of SEQ ID NO: 5 will have at least one amino acid difference, such as, e.g., an amino acid substitution, deletion or addition, as compared to the amino acid region 1-1252 of SEQ ID NO: 5; a BoNT/F variant comprising amino acids 1-1274 of SEQ ID NO: 6 will have at least one amino acid difference, such as, e.g., an amino acid substitution, deletion or addition, as compared to the amino acid region 1-1274 of SEQ ID NO: 6; a BoNT/G variant comprising amino acids 1-1297 of SEQ ID NO: 7 will have at least one amino acid difference, such as, e.g., an amino acid substitution, deletion or addition, as compared to the amino acid region 1-1297 of SEQ ID NO: 7; and a TeNT variant comprising amino acids 1-1315 of SEQ ID NO: 8 will have at least one amino acid difference, such as, e.g., an amino acid substitution, deletion or addition, as compared to the amino acid region 1-1315 of SEQ ID NO: 8.

Any of a variety of sequence alignment methods can be used to determine percent identity, including, without limitation, global methods, local methods and hybrid methods, such as, e.g., segment approach methods. Protocols to determine percent identity are routine procedures within the scope of one skilled in the art and from the teaching herein.

Global methods align sequences from the beginning to the end of the molecule and determine the best alignment by adding up scores of individual residue pairs and by imposing gap penalties. Non-limiting methods include, e.g., CLUSTAL W, see, e.g., Julie D. Thompson et al., *CLUSTAL W: Improving the Sensitivity of Progressive Multiple Sequence Alignment Through Sequence Weighting, Position-Specific Gap Penalties and Weight Matrix Choice,* 22(22) Nucleic Acids Research 4673-4680 (1994); and iterative refinement, see, e.g., Osamu Gotoh, *Significant Improvement in Accuracy of Multiple Protein Sequence Alignments by Iterative Refinement as Assessed by Reference to Structural Alignments,* 264(4) J. Mol. Biol. 823-838 (1996).

Local methods align sequences by identifying one or more conserved motifs shared by all of the input sequences. Non-limiting methods include, e.g., Match-box, see, e.g., Eric Depiereux and Ernest Feytmans, *Match-Box: A Fundamentally New Algorithm for the Simultaneous Alignment of Several Protein Sequences,* 8(5) CABIOS 501-509 (1992); Gibbs sampling, see, e.g., C. E. Lawrence et al., *Detecting Subtle Sequence Signals: A Gibbs Sampling Strategy for Multiple Alignment,* 262(5131) Science 208-214 (1993); Align-M, see, e.g., Ivo Van Walle et al., *Align-M—A New Algorithm for Multiple Alignment of Highly Divergent Sequences,* 20(9) Bioinformatics,:1428-1435 (2004).

Hybrid methods combine functional aspects of both global and local alignment methods. Non-limiting methods include, e.g., segment-to-segment comparison, see, e.g., Burkhard Morgenstern et al., *Multiple DNA and Protein Sequence Alignment Based On Segment-To-Segment Comparison,* 93(22) Proc. Natl. Acad. Sci. U.S.A. 12098-12103 (1996); T-Coffee, see, e.g., Cédric Notredame et al., *T-Coffee: A Novel Algorithm for Multiple Sequence Alignment,* 302(1) J. Mol. Biol. 205-217 (2000); MUSCLE, see, e.g., Robert C. Edgar, *MUSCLE: Multiple Sequence Alignment With High Score Accuracy and High Throughput,* 32(5) Nucleic Acids Res. 1792-1797 (2004); and DIALIGN-T, see, e.g., Amarendran R Subramanian et al., *DIALIGN-T: An Improved Algorithm for Segment-Based Multiple Sequence Alignment,* 6(1) BMC Bioinformatics 66 (2005).

As used herein, the term "naturally occurring Clostridial toxin variant" means any Clostridial toxin produced without the aid of any human manipulation, including, without limitation, Clostridial toxin isoforms produced from alternatively-spliced transcripts, Clostridial toxin isoforms produced by spontaneous mutation and Clostridial toxin subtypes. Non-limiting examples of a Clostridial toxin isoform include, e.g., BoNT/A isoforms, BoNT/B isoforms, BoNT/C1 isoforms, BoNT/D isoforms, BoNT/E isoforms, BoNT/F isoforms, BoNT/G isoforms, and TeNT isoforms. Non-limiting examples of a Clostridial toxin subtype include, e.g., BoNT/A subtypes BoNT/A1, BoNT/A2, BoNT/A3 and BoNT/A4; BoNT/B subtypes BoNT/B1, BoNT/B2, BoNT/B bivalent and BoNT/B nonproteolytic; BoNT/C1 subtypes BoNT/C1-1 and BoNT/C1-2; BoNT/E subtypes BoNT/E1, BoNT/E2 and BoNT/E3; and BoNT/F subtypes BoNT/F1, BoNT/F2, BoNT/F3 and BoNT/F4.

As used herein, the term "non-naturally occurring Clostridial toxin variant" means any Clostridial toxin produced with the aid of human manipulation, including, without limitation, Clostridial toxins produced by genetic engineering using random mutagenesis or rational design and Clostridial toxins produced by chemical synthesis. Non-limiting examples of non-naturally occurring Clostridial toxin variants include, e.g., conservative Clostridial toxin variants, non-conservative Clostridial toxin variants, Clostridial toxin chimeric variants and active Clostridial toxin fragments.

As used herein, the term "conservative Clostridial toxin variant" means a Clostridial toxin that has at least one amino acid substituted by another amino acid or an amino acid analog that has at least one property similar to that of the original amino acid from the reference Clostridial toxin sequence (Table 1). Examples of properties include, without limitation, similar size, topography, charge, hydrophobicity, hydrophilicity, lipophilicity, covalent-bonding capacity, hydrogen-bonding capacity, a physicochemical property, of the like, or any combination thereof. A conservative Clostridial toxin variant can function in substantially the same manner as the reference Clostridial toxin on which the conservative Clostridial toxin variant is based, and can be substituted for the reference Clostridial toxin in any aspect of the present invention. A conservative Clostridial toxin variant may substitute one or more amino acids, two or more amino acids, three or more amino acids, four or more amino acids, five or more amino acids, ten or more amino acids, 20 or more amino acids, 30 or more amino acids, 40 or more amino acids, 50 or more amino acids, 100 or more amino acids, 200 or more amino acids, 300 or more amino acids, 400 or more amino acids, or 500 or more amino acids from the reference Clostridial toxin on which the conservative Clostridial toxin variant is based. A conservative Clostridial toxin variant can also substitute at least 10 contiguous amino acids, at least 15 contiguous amino acids, at least 20 contiguous amino acids, or at least 25 contiguous amino acids from the reference Clostridial toxin on which the conservative Clostridial toxin variant is based, that possess at least 50% amino acid identity, 65% amino acid identity, 75% amino acid identity, 85% amino acid identity or 95% amino acid identity to the reference Clostridial toxin on which the conservative Clostridial toxin variant is based. Non-limiting examples of a conservative Clostridial toxin variant include, e.g., conservative BoNT/A variants, conservative BoNT/B variants, conservative BoNT/C1 variants, conservative BoNT/D variants, conservative BoNT/E variants, conservative BoNT/F variants, conservative BoNT/G variants, and conservative TeNT variants.

As used herein, the term "non-conservative Clostridial toxin variant" means a Clostridial toxin in which 1) at least one amino acid is deleted from the reference Clostridial toxin on which the non-conservative Clostridial toxin variant is based; 2) at least one amino acid added to the reference Clostridial toxin on which the non-conservative Clostridial toxin is based; or 3) at least one amino acid is substituted by another amino acid or an amino acid analog that does not share any property similar to that of the original amino acid from the reference Clostridial toxin sequence (Table 1). A non-conservative Clostridial toxin variant can function in substantially the same manner as the reference Clostridial toxin on which the non-conservative Clostridial toxin variant is based, and can be substituted for the reference Clostridial toxin in any aspect of the present invention. A non-conservative Clostridial toxin variant can delete one or more amino acids, two or more amino acids, three or more amino acids, four or more amino acids, five or more amino acids, and ten or more amino acids from the reference Clostridial toxin on which the non-conservative Clostridial toxin variant is based. A non-conservative Clostridial toxin variant can add one or more amino acids, two or more amino acids, three or more amino acids, four or more amino acids, five or more amino acids, and ten or more amino acids to the reference Clostridial toxin on which the non-conservative Clostridial toxin variant is based. A non-conservative Clostridial toxin variant may substitute one or more amino acids, two or more amino acids, three or more amino acids, four or more amino acids, five or more amino acids, ten or more amino acids, 20 or more amino acids, 30 or more amino acids, 40 or more amino acids, 50 or more amino acids, 100 or more amino acids, 200 or more amino acids, 300 or more amino acids, 400 or more amino acids, or 500 or more amino acids from the reference Clostridial toxin on which the non-conservative Clostridial toxin variant is based. A non-conservative Clostridial toxin variant can also substitute at least 10 contiguous amino acids, at least 15 contiguous amino acids, at least 20 contiguous amino acids, or at least 25 contiguous amino acids from the reference Clostridial toxin on which the non-conservative Clostridial toxin variant is based, that possess at least 50% amino acid identity, 65% amino acid identity, 75% amino acid identity, 85% amino acid identity or 95% amino acid identity to the reference Clostridial toxin on which the non-conservative Clostridial toxin variant is based. Non-limiting examples of a non-conservative Clostridial toxin variant include, e.g., non-conservative BoNT/A variants, non-conservative BoNT/B variants, non-conservative BoNT/C1 variants, non-conservative BoNT/D variants, non-conservative BoNT/E variants, non-conservative BoNT/F variants, non-conservative BoNT/G variants, and non-conservative TeNT variants.

As used herein, the term "Clostridial toxin chimeric variant" means a molecule comprising at least a portion of a Clostridial toxin and at least a portion of at least one other protein to form a toxin with at least one property different from the reference Clostridial toxins of Table 1. Such Clostridial toxin chimeric molecules are described in, e.g., Clifford C. Shone et al., Recombinant Toxin Fragments, U.S. Pat. No. 6,461,617 (Oct. 8, 2002); Keith A. Foster et al., Clostridial Toxin Derivatives Able To Modify Peripheral Sensory Afferent Functions, U.S. Pat. No. 6,395,513 (May 28, 2002); Wei-Jin Lin et al., Neurotoxins with Enhanced Target Specificity, US 2002/0137886 (Sep. 26, 2002); Keith A. Foster et al., Inhibition of Secretion from Non-neural Cells, US 2003/0180289 (Sep. 25, 2003); J. Oliver Dolly et al., Activatable Recombinant Neurotoxins, WO 2001/014570 (Mar. 1, 2001); Clifford C. Shone et al., Recombinant Toxin Fragments, WO 2004/024909 (Mar. 25, 2004); and Keith A. Foster et al., Re-targeted Toxin Conjugates, WO 2005/023309 (Mar. 17, 2005).

It is well documented that toxin molecules can be re-targeted to a cell that is not the toxins' natural target cell. When so re-targeted, these toxins are capable of binding to a desired target cell and, following subsequent translocation into the cytosol, are capable of exerting their effect on the target cell. In this regard, the binding domain is selected so that it will bind to a desired target cell, and allow subsequent passage of the modified Clostridial toxin into an endosome within the target cell. It is envisioned that any non-Clostridial binding domain can be used, including, without limitation, ligands, hormones, growth factors, cytokines, antibodies, antagonists, agonists and reverse-agonists, with the proviso that the non-Clostridial binding domain binds to a cell surface receptor system other than the one used by the Clostridial binding domain of the modified Clostridial toxin. Non-limiting examples of a non-Clostridial binding domain include, growth factors, such as, e.g., Nerve growth factor (NGF), Leukemia inhibitory factor (LIF), Basic fibroblast growth factor (bFGF), Brain-derived neurotrophic factor (BDNF), Neurotrophin-3 (NT-3), Hydra head activator peptide (HHAP), Transforming growth factor 1 (TGF-1), Transforming growth factor 2 (TGF-2), Transforming growth factor 3(TGF-3), Epidermal growth factor (EGF) and Ciliary neurotrophic factor (CNTF); cytokines, such as, e.g., Tumor necrosis factor (TNF-), Interleukin-1 (IL-1), Interleukin-1 (IL-1) and interleukin-8 (IL-8); agonists, such as, e.g., Bradykinin, Dynorphin, β-endorphin, Etorphine, Endomorphin-1, Endomorphin-2Leu-enkephalin, Met-enkephalin, Galanin, Lofentanil, Nociceptin and an opioid; and antibodies, such as, e.g., antibodies against the lactoseries carbohydrate epitopes found on the surface of dorsal root ganglion neurons (e.g. monoclonal antibodies 1B2 and LA4), antibodies against any of the receptors for the ligands given above and antibodies against the surface expressed antigen Thy1 (e.g. monoclonal antibody MRC OX7). Methods of making and using a Clostridial toxin chimeric variant can comprise a modified Clostridial toxin disclosed in the present specification where the binding domain comprises a non-Clostridial toxin binding domain are described in, e.g., Clifford C. Shone et al., supra, (2002); Keith A. Foster et al., supra, (2002); Wei-Jin Lin et al., supra, (2002); Keith A. Foster et al., supra, (2003); J. Oliver Dolly et al., supra, (2001); Clifford C. Shone et al., supra, (2004); and Keith A. Foster et al., supra, (2005).

Thus, in an embodiment, a Clostridial toxin chimeric variant can comprise a modified Clostridial toxin disclosed in the present specification where the binding domain comprises a non-Clostridial toxin binding domain. In aspects of this embodiment, a non-Clostridial toxin binding domain can be, e.g., a ligand, a hormone, a growth factor, a cytokine, an antibody, an opioid, an antagonist, an agonist or a reverse-agonist. In other aspects of this embodiment, a non-Clostridial toxin binding domain is a Nerve growth factor (NGF), a Leukemia inhibitory factor (LIF), a Basic fibroblast growth factor (bFGF), a Brain-derived neurotrophic factor (BDNF), a Neurotrophin-3 (NT-3), a Hydra head activator peptide (HHAP), a Transforming growth factor 1 (TGF-1), a Transforming growth factor 2 (TGF-2), a Transforming growth factor 3(TGF-3), an Epidermal growth factor (EGF) or a Ciliary neurotrophic factor (CNTF). In still other aspects of this embodiment, a non-Clostridial toxin binding domain is a Tumor necrosis factor (TNF-), an Interleukin-1 (IL-1), an Interleukin-1 (IL-1) or an Interleukin-8 (IL-8). In yet other aspects of this embodiment, a non-Clostridial toxin binding domain is a Bradykinin, a Dynorphin, a β-endorphin, an Etorphine, an Endomorphin-1, an Endomorphin-2, a Leu-enkephalin, a Met-enkephalin, a Galanin, a Lofentanil or a Nociceptin. In still other aspects of this embodiment, a non-Clostridial toxin binding domain is an antibody against the lactoseries carbohydrate epitopes found on the surface of dorsal root ganglion neurons (e.g. monoclonal antibodies 1B2 and LA4), an antibody against any of the receptors for the binding domains given above or an antibody against the surface expressed antigen Thy1 (e.g. monoclonal antibody MRC OX7).

It is also envisioned that any of a variety of Clostridial toxin fragments can be useful in aspects of the present invention with the proviso that these active fragments can execute the overall cellular mechanism whereby a Clostridial toxin proteolytically cleaves a substrate. Thus, aspects of this embodiment can include Clostridial toxin fragments having a length of, e.g., at least 300 amino acids, at least 400 amino acids, at least 500 amino acids, at least 600 amino acids, at least 700 amino acids, at least 800 amino acids, at least 900 amino acids, at least 1000 amino acids, at least 1100 amino acids and at least 1200 amino acids. Other aspects of this embodiment, can include Clostridial toxin fragments having a length of, e.g., at most 300 amino acids, at most 400 amino acids, at most 500 amino acids, at most 600 amino acids, at most 700 amino acids, at most 800 amino acids, at most 900 amino acids, at most 1000 amino acids, at most 1100 amino acids and at most 1200 amino acids.

It is also envisioned that any of a variety of Clostridial toxin fragments comprising the light chain can be useful in aspects of the present invention with the proviso that these light chain fragments can specifically target the core components of the neurotransmitter release apparatus and thus participate in executing the overall cellular mechanism whereby a Clostridial toxin proteolytically cleaves a substrate. The light chains of Clostridial toxins are approximately 420-460 amino acids in length and comprise an enzymatic domain (Table 1). Research has shown that the entire length of a Clostridial toxin light chain is not necessary for the enzymatic activity of the enzymatic domain. As a non-limiting example, the first eight amino acids of the BoNT/A light chain (residues 1-8 of SEQ ID NO: 1) are not required for enzymatic activity. As another non-limiting example, the first eight amino acids of the TeNT light chain (residues 1-8 of SEQ ID NO: 8) are not required for enzymatic activity. Likewise, the carboxyl-terminus of the light chain is not necessary for activity. As a non-limiting example, the last 32 amino acids of the BoNT/A light chain (residues 417-448 of SEQ ID NO: 1) are not required for enzymatic activity. As another non-limiting example, the last 31 amino acids of the TeNT light chain (residues 427-457 of SEQ ID NO: 8) are not required for enzymatic activity. Thus, aspects of this embodiment can include Clostridial toxin light chains comprising an enzymatic domain having a length of, e.g., at least 350 amino acids, at least 375 amino acids, at least 400 amino acids, at least 425 amino acids and at least 450 amino acids. Other aspects of this embodiment can include Clostridial toxin light chains comprising an enzymatic domain having a length of, e.g., at most 350 amino acids, at most 375 amino acids, at most 400 amino acids, at most 425 amino acids and at most 450 amino acids.

It is also envisioned that any of a variety of Clostridial toxin $H_N$ regions comprising a translocation domain can be useful in aspects of the present invention with the proviso that these active fragments can facilitate the release of the LC from intracellular vesicles into the cytoplasm of the target cell and thus participate in executing the overall cellular mechanism whereby a Clostridial toxin proteolytically cleaves a substrate. The $H_N$ regions from the heavy chains of Clostridial toxins are approximately 410-430 amino acids in length and comprise a translocation domain (Table 1). Research has shown that the entire length of a $H_N$ region from a Clostridial toxin heavy chain is not necessary for the translocating activity of the translocation domain. Thus, aspects of this embodiment can include Clostridial toxin $H_N$ regions comprising a translocation domain having a length of, e.g., at least 350 amino acids, at least 375 amino acids, at least 400 amino acids and at least 425 amino acids. Other aspects of this embodiment can include Clostridial toxin $H_N$ regions comprising translocation domain having a length of, e.g., at most 350 amino acids, at most 375 amino acids, at most 400 amino acids and at most 425 amino acids.

It is also envisioned that any of a variety of Clostridial toxin $H_C$ regions comprising a binding domain can be useful in aspects of the present invention with the proviso that these active fragments can determine the binding activity and binding specificity of the toxin to the receptor complex located at the surface of the target cell execute the overall cellular mechanism whereby a Clostridial toxin proteolytically cleaves a substrate. The $H_C$ regions from the heavy chains of Clostridial toxins are approximately 400-440 amino acids in length and comprise a binding domain (Table 1). Research has shown that the entire length of a $H_C$ region from a Clostridial toxin heavy chain is not necessary for the binding activity of the binding domain. Thus, aspects of this embodiment can include Clostridial toxin $H_C$ regions comprising a binding domain having a length of, e.g., at least 350 amino acids, at least 375 amino acids, at least 400 amino acids and at least 425 amino acids. Other aspects of this embodiment can include Clostridial toxin $H_C$ regions comprising a binding domain having a length of, e.g., at most 350 amino acids, at most 375 amino acids, at most 400 amino acids and at most 425 amino acids.

Thus, in an embodiment, a Clostridial toxin comprises a Clostridial toxin enzymatic domain, a Clostridial toxin translocation domain and a Clostridial toxin binding domain. In an aspect of this embodiment, a Clostridial toxin comprises a naturally occurring Clostridial toxin variant, such as, e.g., a Clostridial toxin isoform or a Clostridial toxin subtype. In another aspect of this embodiment, a Clostridial toxin comprises a non-naturally occurring Clostridial toxin variant, such as, e.g., a conservative Clostridial toxin variant, a non-conservative Clostridial toxin variant or an active Clostridial toxin fragment, or any combination thereof. In another aspect of this embodiment, a Clostridial toxin comprises a Clostridial toxin enzymatic domain or an active fragment thereof, a Clostridial toxin translocation domain or an active fragment thereof, a Clostridial toxin binding domain or an active fragment thereof, or any combination thereof. In other aspects of this embodiment, a Clostridial toxin can comprise a BoNT/A, a BoNT/B, a BoNT/C1, a BoNT/D, a BoNT/E, a BoNT/F, a BoNT/G or a TeNT.

In another embodiment, a Clostridial toxin comprises a BoNT/A. In an aspect of this embodiment, a BoNT/A comprises a BoNT/A enzymatic domain, a BoNT/A translocation domain and a BoNT/A binding domain. In another aspect of this embodiment, a BoNT/A comprises SEQ ID NO: 1. In another aspect of this embodiment, a BoNT/A comprises a naturally occurring BoNT/A variant, such as, e.g., a BoNT/A isoform or a BoNT/A subtype. In another aspect of this embodiment, a BoNT/A comprises a naturally occurring BoNT/A variant of SEQ ID NO: 1, such as, e.g., a BoNT/A isoform of SEQ ID NO: 1 or a BoNT/A subtype of SEQ ID NO: 1. In still another aspect of this embodiment, a BoNT/A comprises a non-naturally occurring BoNT/A variant, such as, e.g., a conservative BoNT/A variant, a non-conservative BoNT/A variant or an active BoNT/A fragment, or any combination thereof. In still another aspect of this embodiment, a BoNT/A comprises a non-naturally occurring BoNT/A variant of SEQ ID NO: 1, such as, e.g., a conservative BoNT/A variant of SEQ ID NO: 1, a non-conservative BoNT/A variant of SEQ ID NO: 1 or an active BoNT/A fragment of SEQ ID NO: 1, or any combination thereof. In yet another aspect of this embodiment, a BoNT/A comprises a BoNT/A enzymatic domain or an active fragment thereof, a BoNT/A translocation domain or an active fragment thereof, a BoNT/A binding domain or an active fragment thereof, or any combination thereof. In yet another aspect of this embodiment, a BoNT/A comprising a BoNT/A enzymatic domain of amino acids 1-448 from SEQ ID NO: 1 or an active fragment thereof, a BoNT/A translocation domain of amino acids 449-871 from SEQ ID NO: 1 or an active fragment thereof, a BoNT/A binding domain of amino acids 872-1296 from SEQ ID NO: 1 or an active fragment thereof, and any combination thereof.

In other aspects of this embodiment, a BoNT/A comprises a polypeptide having, e.g., at least 70% amino acid identity with SEQ ID NO: 1, at least 75% amino acid identity with the SEQ ID NO: 1, at least 80% amino acid identity with SEQ ID NO: 1, at least 85% amino acid identity with SEQ ID NO: 1, at least 90% amino acid identity with SEQ ID NO: 1 or at least 95% amino acid identity with SEQ ID NO: 1. In yet other aspects of this embodiment, a BoNT/A comprises a polypeptide having, e.g., at most 70% amino acid identity with SEQ ID NO: 1, at most 75% amino acid identity with the SEQ ID NO: 1, at most 80% amino acid identity with SEQ ID NO: 1, at most 85% amino acid identity with SEQ ID NO: 1, at most 90% amino acid identity with SEQ ID NO: 1 or at most 95% amino acid identity with SEQ ID NO: 1.

In other aspects of this embodiment, a BoNT/A comprises a polypeptide having, e.g., at most one, two, three, four, five, six, seven, eight, nine, 10, 20, 30, 40, 50, 100, 200 or 500 non-contiguous amino acid substitutions relative to SEQ ID NO: 1. In other aspects of this embodiment, a BoNT/A comprises a polypeptide having, e.g., at least one, two, three, four, five, six, seven, eight, nine, 10, 20, 30, 40, 50, 100, 200 or 500 non-contiguous amino acid substitutions relative to SEQ ID NO: 1. In yet other aspects of this embodiment, a BoNT/A comprises a polypeptide having, e.g., at most one, two, three, four, five, six, seven, eight, nine, 10, 20, 30, 40, 50, 100, 200 or 500 non-contiguous amino acid deletions relative to SEQ ID NO: 1. In other aspects of this embodiment, a BoNT/A comprises a polypeptide having, e.g., at least one, two, three, four, five, six, seven, eight, nine, 10, 20, 30, 40, 50, 100, 200 or 500 non-contiguous amino acid deletions relative to SEQ ID NO: 1. In still other aspects of this embodiment, a BoNT/A comprises a polypeptide having, e.g., at most one, two, three, four, five, six, seven, eight, nine, 10, 20, 30, 40, 50, 100, 200 or 500 non-contiguous amino acid additions relative to SEQ ID NO: 1. In other aspects of this embodiment, a BoNT/A comprises a polypeptide having, e.g., at least one, two, three, four, five, six, seven, eight, nine, 10, 20, 30, 40, 50, 100, 200 or 500 non-contiguous amino acid additions relative to SEQ ID NO: 1.

In other aspects of this embodiment, a BoNT/A comprises a polypeptide having, e.g., at most one, two, three, four, five, six, seven, eight, nine, 10, 20, 30, 40, 50, 100, 200 or 500 contiguous amino acid substitutions relative to SEQ ID NO: 1. In other aspects of this embodiment, a BoNT/A comprises a polypeptide having, e.g., at least one, two, three, four, five, six, seven, eight, nine, 10, 20, 30, 40, 50, 100, 200 or 500 contiguous amino acid substitutions relative to SEQ ID NO: 1. In yet other aspects of this embodiment, a BoNT/A comprises a polypeptide having, e.g., at most one, two, three, four, five, six, seven, eight, nine, 10, 20, 30, 40, 50, 100, 200 or 500 contiguous amino acid deletions relative to SEQ ID NO: 1. In other aspects of this embodiment, a BoNT/A comprises a polypeptide having, e.g., at least one, two, three, four, five, six, seven, eight, nine, 10, 20, 30, 40, 50, 100, 200 or 500 contiguous amino acid deletions relative to SEQ ID NO: 1. In still other aspects of this embodiment, a BoNT/A comprises a polypeptide having, e.g., at most one, two, three, four, five, six, seven, eight, nine, 10, 20, 30, 40, 50, 100, 200 or 500 contiguous amino acid additions relative to SEQ ID NO: 1. In other aspects of this embodiment, a BoNT/A comprises a polypeptide having, e.g., at least one, two, three, four, five, six, seven, eight, nine, 10, 20, 30, 40, 50, 100, 200 or 500 contiguous amino acid additions relative to SEQ ID NO: 1.

In another embodiment, a Clostridial toxin comprises a BoNT/B. In an aspect of this embodiment, a BoNT/B comprises a BoNT/B enzymatic domain, a BoNT/B translocation domain and a BoNT/B binding domain. In another aspect of this embodiment, a BoNT/B comprises SEQ ID NO: 2. In another aspect of this embodiment, a BoNT/B comprises a naturally occurring BoNT/B variant, such as, e.g., a BoNT/β isoform or a BoNT/B subtype. In another aspect of this embodiment, a BoNT/B comprises a naturally occurring BoNT/B variant of SEQ ID NO: 2, such as, e.g., a BoNT/B isoform of SEQ ID NO: 2 or a BoNT/B subtype of SEQ ID NO: 2. In still another aspect of this embodiment, a BoNT/B comprises a non-naturally occurring BoNT/B variant, such as, e.g., a conservative BoNT/B variant, a non-conservative BoNT/B variant or an active BoNT/B fragment, or any combination thereof. In still another aspect of this embodiment, a BoNT/B comprises a non-naturally occurring BoNT/B variant of SEQ ID NO: 2, such as, e.g., a conservative BoNT/B variant of SEQ ID NO: 2, a non-conservative BoNT/B variant of SEQ ID NO: 2 or an active BoNT/B fragment of SEQ ID NO: 2, or any combination thereof. In yet another aspect of this embodiment, a BoNT/B comprising a BoNT/B enzymatic domain or an active fragment thereof, a BoNT/B translocation domain or active fragment thereof, a BoNT/B binding domain or active fragment thereof, and any combination thereof. In yet another aspect of this embodiment, a BoNT/B comprising a BoNT/B enzymatic domain of amino acids 1-441 from SEQ ID NO: 2 or active fragment thereof, a BoNT/B translocation domain of amino acids 442-858 from SEQ ID NO: 2 or active fragment thereof, a BoNT/B binding domain of amino acids 859-1291 from SEQ ID NO: 2 or active fragment thereof, and any combination thereof.

In other aspects of this embodiment, a BoNT/B comprises a polypeptide having, e.g., at least 70% amino acid identity with SEQ ID NO: 2, at least 75% amino acid identity with the SEQ ID NO: 2, at least 80% amino acid identity with SEQ ID NO: 2, at least 85% amino acid identity with SEQ ID NO: 2, at least 90% amino acid identity with SEQ ID NO: 2 or at least 95% amino acid identity with SEQ ID NO: 2. In yet other aspects of this embodiment, a BoNT/B comprises a polypeptide having, e.g., at most 70% amino acid identity with SEQ ID NO: 2, at most 75% amino acid identity with the SEQ ID NO: 2, at most 80% amino acid identity with SEQ ID NO: 2, at most 85% amino acid identity with SEQ ID NO: 2, at most 90% amino acid identity with SEQ ID NO: 2 or at most 95% amino acid identity with SEQ ID NO: 2.

In other aspects of this embodiment, a BoNT/B comprises a polypeptide having, e.g., at most one, two, three, four, five, six, seven, eight, nine, 10, 20, 30, 40, 50, 100, 200 or 500 non-contiguous amino acid substitutions relative to SEQ ID NO: 2. In other aspects of this embodiment, a BoNT/B comprises a polypeptide having, e.g., at least one, two, three, four, five, six, seven, eight, nine, 10, 20, 30, 40, 50, 100, 200 or 500 non-contiguous amino acid substitutions relative to SEQ ID NO: 2. In yet other aspects of this embodiment, a BoNT/B comprises a polypeptide having, e.g., at most one, two, three, four, five, six, seven, eight, nine, 10, 20, 30, 40, 50, 100, 200 or 500 non-contiguous amino acid deletions relative to SEQ ID NO: 2. In other aspects of this embodiment, a BoNT/B comprises a polypeptide having, e.g., at least one, two, three, four, five, six, seven, eight, nine, 10, 20, 30, 40, 50, 100, 200 or 500 non-contiguous amino acid deletions relative to SEQ ID NO: 2. In still other aspects of this embodiment, a BoNT/B comprises a polypeptide having, e.g., at most one, two, three, four, five, six, seven, eight, nine, 10, 20, 30, 40, 50, 100, 200 or 500 non-contiguous amino acid additions relative to SEQ ID NO: 2. In other aspects of this embodiment, a BoNT/B comprises a polypeptide having, e.g., at least one, two, three, four, five, six, seven, eight, nine, 10, 20, 30, 40, 50, 100, 200 or 500 non-contiguous amino acid additions relative to SEQ ID NO: 2.

In other aspects of this embodiment, a BoNT/B comprises a polypeptide having, e.g., at most one, two, three, four, five, six, seven, eight, nine, 10, 20, 30, 40, 50, 100, 200 or 500 contiguous amino acid substitutions relative to SEQ ID NO: 2. In other aspects of this embodiment, a BoNT/B comprises a polypeptide having, e.g., at least one, two, three, four, five, six, seven, eight, nine, 10, 20, 30, 40, 50, 100, 200 or 500 contiguous amino acid substitutions relative to SEQ ID NO:

2. In yet other aspects of this embodiment, a BoNT/B comprises a polypeptide having, e.g., at most one, two, three, four, five, six, seven, eight, nine, 10, 20, 30, 40, 50, 100, 200 or 500 contiguous amino acid deletions relative to SEQ ID NO: 2. In other aspects of this embodiment, a BoNT/B comprises a polypeptide having, e.g., at least one, two, three, four, five, six, seven, eight, nine, 10, 20, 30, 40, 50, 100, 200 or 500 contiguous amino acid deletions relative to SEQ ID NO: 2. In still other aspects of this embodiment, a BoNT/B comprises a polypeptide having, e.g., at most one, two, three, four, five, six, seven, eight, nine, 10, 20, 30, 40, 50, 100, 200 or 500 contiguous amino acid additions relative to SEQ ID NO: 2. In other aspects of this embodiment, a BoNT/B comprises a polypeptide having, e.g., at least one, two, three, four, five, six, seven, eight, nine, 10, 20, 30, 40, 50, 100, 200 or 500 contiguous amino acid additions relative to SEQ ID NO: 2.

In another embodiment, a Clostridial toxin comprises a BoNT/C1. In an aspect of this embodiment, a BoNT/C1 comprises a BoNT/C1 enzymatic domain, a BoNT/C1 translocation domain and a BoNT/C1 binding domain. In another aspect of this embodiment, a BoNT/C1 comprises SEQ ID NO: 3.

In another aspect of this embodiment, a BoNT/C1 comprises a naturally occurring BoNT/C1 variant, such as, e.g., a BoNT/C1 isoform or a BoNT/C1 subtype. In another aspect of this embodiment, a BoNT/C1 comprises a naturally occurring BoNT/C1 variant of SEQ ID NO: 3, such as, e.g., a BoNT/C1 isoform of SEQ ID NO: 3 or a BoNT/C1 subtype of SEQ ID NO: 3. In still another aspect of this embodiment, a BoNT/C1 comprises a non-naturally occurring BoNT/C1 variant, such as, e.g., a conservative BoNT/C1 variant, a non-conservative BoNT/C1 variant or an active BoNT/C1 fragment, or any combination thereof. In still another aspect of this embodiment, a BoNT/C1 comprises a non-naturally occurring BoNT/C1 variant of SEQ ID NO: 3, such as, e.g., a conservative BoNT/C1 variant of SEQ ID NO: 3, a non-conservative BoNT/C1 variant of SEQ ID NO: 3 or an active BoNT/C1 fragment of SEQ ID NO: 3, or any combination thereof. In yet another aspect of this embodiment, a BoNT/C1 comprises a BoNT/C1 enzymatic domain or active fragment thereof, a BoNT/C1 translocation domain or active fragment thereof, a BoNT/C1 binding domain or active fragment thereof, and any combination thereof. In yet another aspect of this embodiment, a BoNT/C1 comprises a BoNT/C1 enzymatic domain of amino acid 1-449 from SEQ ID NO: 3 or active fragment thereof, a BoNT/C1 translocation domain of amino acids 450-866 from SEQ ID NO: 3 or active fragment thereof, a BoNT/C1 binding domain of amino acids 867-1291 from SEQ ID NO: 3 or active fragment thereof, and any combination thereof.

In other aspects of this embodiment, a BoNT/C1 comprises a polypeptide having, e.g., at least 70% amino acid identity with SEQ ID NO: 3, at least 75% amino acid identity with the SEQ ID NO: 3, at least 80% amino acid identity with SEQ ID NO: 3, at least 85% amino acid identity with SEQ ID NO: 3, at least 90% amino acid identity with SEQ ID NO: 3 or at least 95% amino acid identity with SEQ ID NO: 3. In yet other aspects of this embodiment, a BoNT/C1 comprises a polypeptide having, e.g., at most 70% amino acid identity with SEQ ID NO: 3, at most 75% amino acid identity with the SEQ ID NO: 3, at most 80% amino acid identity with SEQ ID NO: 3, at most 85% amino acid identity with SEQ ID NO: 3, at most 90% amino acid identity with SEQ ID NO: 3 or at most 95% amino acid identity with SEQ ID NO: 3.

In other aspects of this embodiment, a BoNT/C1 comprises a polypeptide having, e.g., at most one, two, three, four, five, six, seven, eight, nine, 10, 20, 30, 40, 50, 100, 200 or 500 non-contiguous amino acid substitutions relative to SEQ ID NO: 3. In other aspects of this embodiment, a BoNT/C1 comprises a polypeptide having, e.g., at least one, two, three, four, five, six, seven, eight, nine, 10, 20, 30, 40, 50, 100, 200 or 500 non-contiguous amino acid substitutions relative to SEQ ID NO: 3. In yet other aspects of this embodiment, a BoNT/C1 comprises a polypeptide having, e.g., at most one, two, three, four, five, six, seven, eight, nine, 10, 20, 30, 40, 50, 100, 200 or 500 non-contiguous amino acid deletions relative to SEQ ID NO: 3. In other aspects of this embodiment, a BoNT/C1 comprises a polypeptide having, e.g., at least one, two, three, four, five, six, seven, eight, nine, 10, 20, 30, 40, 50, 100, 200 or 500 non-contiguous amino acid deletions relative to SEQ ID NO: 3. In still other aspects of this embodiment, a BoNT/C1 comprises a polypeptide having, e.g., at most one, two, three, four, five, six, seven, eight, nine, 10, 20, 30, 40, 50, 100, 200 or 500 non-contiguous amino acid additions relative to SEQ ID NO: 3. In other aspects of this embodiment, a BoNT/C1 comprises a polypeptide having, e.g., at least one, two, three, four, five, six, seven, eight, nine, 10, 20, 30, 40, 50, 100, 200 or 500 non-contiguous amino acid additions relative to SEQ ID NO: 3.

In other aspects of this embodiment, a BoNT/C1 comprises a polypeptide having, e.g., at most one, two, three, four, five, six, seven, eight, nine, 10, 20, 30, 40, 50, 100, 200 or 500 contiguous amino acid substitutions relative to SEQ ID NO: 3. In other aspects of this embodiment, a BoNT/C1 comprises a polypeptide having, e.g., at least one, two, three, four, five, six, seven, eight, nine, 10, 20, 30, 40, 50, 100, 200 or 500 contiguous amino acid substitutions relative to SEQ ID NO: 3. In yet other aspects of this embodiment, a BoNT/C1 comprises a polypeptide having, e.g., at most one, two, three, four, five, six, seven, eight, nine, 10, 20, 30, 40, 50, 100, 200 or 500 contiguous amino acid deletions relative to SEQ ID NO: 3. In other aspects of this embodiment, a BoNT/C1 comprises a polypeptide having, e.g., at least one, two, three, four, five, six, seven, eight, nine, 10, 20, 30, 40, 50, 100, 200 or 500 contiguous amino acid deletions relative to SEQ ID NO: 3. In still other aspects of this embodiment, a BoNT/C1 comprises a polypeptide having, e.g., at most one, two, three, four, five, six, seven, eight, nine, 10, 20, 30, 40, 50, 100, 200 or 500 contiguous amino acid additions relative to SEQ ID NO: 3. In other aspects of this embodiment, a BoNT/C1 comprises a polypeptide having, e.g., at least one, two, three, four, five, six, seven, eight, nine, 10, 20, 30, 40, 50, 100, 200 or 500 contiguous amino acid additions relative to SEQ ID NO: 3.

In another embodiment, a Clostridial toxin comprises a BoNT/D. In an aspect of this embodiment, a BoNT/D comprises a BoNT/D enzymatic domain, a BoNT/D translocation domain and a BoNT/D binding domain. In another aspect of this embodiment, a BoNT/D comprises SEQ ID NO: 4. In another aspect of this embodiment, a BoNT/D comprises a naturally occurring BoNT/D variant, such as, e.g., a BoNT/D isoform or a BoNT/D subtype. In another aspect of this embodiment, a BoNT/D comprises a naturally occurring BoNT/D variant of SEQ ID NO: 4, such as, e.g., a BoNT/D isoform of SEQ ID NO: 4 or a BoNT/D subtype of SEQ ID NO: 4. In still another aspect of this embodiment, a BoNT/D comprises a non-naturally occurring BoNT/D variant, such as, e.g., a conservative BoNT/D variant, a non-conservative BoNT/D variant or an active BoNT/D fragment, or any combination thereof. In still another aspect of this embodiment, a BoNT/D comprises a non-naturally occurring BoNT/D variant of SEQ ID NO: 4, such as, e.g., a conservative BoNT/D variant of SEQ ID NO: 4, a non-conservative BoNT/D variant of SEQ ID NO: 4 or an active BoNT/D fragment of SEQ ID NO: 4, or any combination thereof. In yet another aspect of this embodiment, a BoNT/D comprises a BoNT/D enzymatic domain or an active fragment thereof, a BoNT/D translocation domain or an active fragment thereof, a BoNT/D binding domain or an active fragment thereof, or any combination thereof. In yet another aspect of this embodiment, a BoNT/D comprising a BoNT/D enzymatic domain of amino acids 1-445 from SEQ ID NO: 4 or an active fragment thereof, a BoNT/D translocation domain of amino acids 446-862 from SEQ ID NO: 4 or an active fragment thereof, a BoNT/D binding domain of amino acids 863-1276 from SEQ ID NO: 4 or an active fragment thereof, and any combination thereof.

In other aspects of this embodiment, a BoNT/D comprises a polypeptide having, e.g., at least 70% amino acid identity with SEQ ID NO: 4, at least 75% amino acid identity with the SEQ ID NO: 4, at least 80% amino acid identity with SEQ ID NO: 4, at least 85% amino acid identity with SEQ ID NO: 4, at least 90% amino acid identity with SEQ ID NO: 4 or at least 95% amino acid identity with SEQ ID NO: 4. In yet other aspects of this embodiment, a BoNT/D comprises a polypeptide having, e.g., at most 70% amino acid identity with SEQ ID NO: 4, at most 75% amino acid identity with the SEQ ID NO: 4, at most 80% amino acid identity with SEQ ID NO: 4, at most 85% amino acid identity with SEQ ID NO: 4, at most 90% amino acid identity with SEQ ID NO: 4 or at most 95% amino acid identity with SEQ ID NO: 4.

In other aspects of this embodiment, a BoNT/D comprises a polypeptide having, e.g., at most one, two, three, four, five, six, seven, eight, nine, 10, 20, 30, 40, 50, 100, 200 or 500 non-contiguous amino acid substitutions relative to SEQ ID NO: 4. In other aspects of this embodiment, a BoNT/D comprises a polypeptide having, e.g., at least one, two, three, four, five, six, seven, eight, nine, 10, 20, 30, 40, 50, 100, 200 or 500 non-contiguous amino acid substitutions relative to SEQ ID NO: 4. In yet other aspects of this embodiment, a BoNT/D comprises a polypeptide having, e.g., at most one, two, three, four, five, six, seven, eight, nine, 10, 20, 30, 40, 50, 100, 200 or 500 non-contiguous amino acid deletions relative to SEQ ID NO: 4. In other aspects of this embodiment, a BoNT/D comprises a polypeptide having, e.g., at least one, two, three, four, five, six, seven, eight, nine, 10, 20, 30, 40, 50, 100, 200 or 500 non-contiguous amino acid deletions relative to SEQ ID NO: 4. In still other aspects of this embodiment, a BoNT/D comprises a polypeptide having, e.g., at most one, two, three, four, five, six, seven, eight, nine, 10, 20, 30, 40, 50, 100, 200 or 500 non-contiguous amino acid additions relative to SEQ ID NO: 4. In other aspects of this embodiment, a BoNT/D comprises a polypeptide having, e.g., at least one, two, three, four, five, six, seven, eight, nine, 10, 20, 30, 40, 50, 100, 200 or 500 non-contiguous amino acid additions relative to SEQ ID NO: 4.

In other aspects of this embodiment, a BoNT/D comprises a polypeptide having, e.g., at most one, two, three, four, five, six, seven, eight, nine, 10, 20, 30, 40, 50, 100, 200 or 500 contiguous amino acid substitutions relative to SEQ ID NO: 4. In other aspects of this embodiment, a BoNT/D comprises a polypeptide having, e.g., at least one, two, three, four, five, six, seven, eight, nine, 10, 20, 30, 40, 50, 100, 200 or 500 contiguous amino acid substitutions relative to SEQ ID NO: 4. In yet other aspects of this embodiment, a BoNT/D comprises a polypeptide having, e.g., at most one, two, three, four, five, six, seven, eight, nine, 10, 20, 30, 40, 50, 100, 200 or 500 contiguous amino acid deletions relative to SEQ ID NO: 4. In other aspects of this embodiment, a BoNT/D comprises a polypeptide having, e.g., at least one, two, three, four, five, six, seven, eight, nine, 10, 20, 30, 40, 50, 100, 200 or 500 contiguous amino acid deletions relative to SEQ ID NO: 4. In still other aspects of this embodiment, a BoNT/D comprises a polypeptide having, e.g., at most one, two, three, four, five, six, seven, eight, nine, 10, 20, 30, 40, 50, 100, 200 or 500 contiguous amino acid additions relative to SEQ ID NO: 4. In other aspects of this embodiment, a BoNT/D comprises a polypeptide having, e.g., at least one, two, three, four, five, six, seven, eight, nine, 10, 20, 30, 40, 50, 100, 200 or 500 contiguous amino acid additions relative to SEQ ID NO: 4.

In another embodiment, a Clostridial toxin comprises a BoNT/E. In an aspect of this embodiment, a BoNT/E comprises a BoNT/E enzymatic domain, a BoNT/E translocation domain and a BoNT/E binding domain. In another aspect of this embodiment, a BoNT/E comprises SEQ ID NO: 5. In another aspect of this embodiment, a BoNT/E comprises a naturally occurring BoNT/E variant, such as, e.g., a BoNT/E isoform or a BoNT/E subtype. In another aspect of this embodiment, a BoNT/E comprises a naturally occurring BoNT/E variant of SEQ ID NO: 5, such as, e.g., a BoNT/E isoform of SEQ ID NO: 5 or a BoNT/E subtype of SEQ ID NO: 5. In still another aspect of this embodiment, a BoNT/E comprises a non-naturally occurring BoNT/E variant, such as, e.g., a conservative BoNT/E variant, a non-conservative BoNT/E variant or an active BoNT/E fragment, or any combination thereof. In still another aspect of this embodiment, a BoNT/E comprises a non-naturally occurring BoNT/E variant of SEQ ID NO: 5, such as, e.g., a conservative BoNT/E variant of SEQ ID NO: 5, a non-conservative BoNT/E variant of SEQ ID NO: 5 or an active BoNT/E fragment of SEQ ID NO: 5, or any combination thereof. In yet another aspect of this embodiment, a BoNT/E comprising a BoNT/E enzymatic domain or an active fragment thereof, a BoNT/E translocation domain or active fragment thereof, a BoNT/E binding domain or active fragment thereof, and any combination thereof. In yet another aspect of this embodiment, a BoNT/E comprising a BoNT/E enzymatic domain of amino acids 1-422 from SEQ ID NO: 5 or active fragment thereof, a BoNT/E translocation domain of amino acids 423-845 from SEQ ID NO: 5 or active fragment thereof, a BoNT/E binding domain of amino acids 846-1252 from SEQ ID NO: 5 or active fragment thereof, and any combination thereof.

In other aspects of this embodiment, a BoNT/E comprises a polypeptide having, e.g., at least 70% amino acid identity with SEQ ID NO: 5, at least 75% amino acid identity with the SEQ ID NO: 5, at least 80% amino acid identity with SEQ ID NO: 5, at least 85% amino acid identity with SEQ ID NO: 5, at least 90% amino acid identity with SEQ ID NO: 5 or at least 95% amino acid identity with SEQ ID NO: 5. In yet other aspects of this embodiment, a BoNT/E comprises a polypeptide having, e.g., at most 70% amino acid identity with SEQ ID NO: 5, at most 75% amino acid identity with the SEQ ID NO: 5, at most 80% amino acid identity with SEQ ID NO: 5, at most 85% amino acid identity with SEQ ID NO: 5, at most 90% amino acid identity with SEQ ID NO: 5 or at most 95% amino acid identity with SEQ ID NO: 5.

In other aspects of this embodiment, a BoNT/E comprises a polypeptide having, e.g., at most one, two, three, four, five, six, seven, eight, nine, 10, 20, 30, 40, 50, 100, 200 or 500 non-contiguous amino acid substitutions relative to SEQ ID NO: 5. In other aspects of this embodiment, a BoNT/E comprises a polypeptide having, e.g., at least one, two, three, four, five, six, seven, eight, nine, 10, 20, 30, 40, 50, 100, 200 or 500 non-contiguous amino acid substitutions relative to SEQ ID NO: 5. In yet other aspects of this embodiment, a BoNT/E comprises a polypeptide having, e.g., at most one, two, three, four, five, six, seven, eight, nine, 10, 20, 30, 40, 50, 100, 200 or 500 non-contiguous amino acid deletions relative to SEQ ID NO: 5. In other aspects of this embodiment, a BoNT/E comprises a polypeptide having, e.g., at least one, two, three, four, five, six, seven, eight, nine, 10, 20, 30, 40, 50, 100, 200 or 500 non-contiguous amino acid deletions relative to SEQ ID NO: 5. In still other aspects of this embodiment, a BoNT/E comprises a polypeptide having, e.g., at most one, two, three, four, five, six, seven, eight, nine, 10, 20, 30, 40, 50, 100, 200 or 500 non-contiguous amino acid additions relative to SEQ ID NO: 5. In other aspects of this embodiment, a BoNT/E comprises a polypeptide having, e.g., at least one, two, three, four, five, six, seven, eight, nine, 10, 20, 30, 40, 50, 100, 200 or 500 non-contiguous amino acid additions relative to SEQ ID NO: 5.

In other aspects of this embodiment, a BoNT/E comprises a polypeptide having, e.g., at most one, two, three, four, five, six, seven, eight, nine, 10, 20, 30, 40, 50, 100, 200 or 500 contiguous amino acid substitutions relative to SEQ ID NO: 5. In other aspects of this embodiment, a BoNT/E comprises a polypeptide having, e.g., at least one, two, three, four, five, six, seven, eight, nine, 10, 20, 30, 40, 50, 100, 200 or 500 contiguous amino acid substitutions relative to SEQ ID NO: 5. In yet other aspects of this embodiment, a BoNT/E comprises a polypeptide having, e.g., at most one, two, three, four, five, six, seven, eight, nine, 10, 20, 30, 40, 50, 100, 200 or 500 contiguous amino acid deletions relative to SEQ ID NO: 5. In other aspects of this embodiment, a BoNT/E comprises a polypeptide having, e.g., at least one, two, three, four, five, six, seven, eight, nine, 10, 20, 30, 40, 50, 100, 200 or 500 contiguous amino acid deletions relative to SEQ ID NO: 5. In still other aspects of this embodiment, a BoNT/E comprises a polypeptide having, e.g., at most one, two, three, four, five, six, seven, eight, nine, 10, 20, 30, 40, 50, 100, 200 or 500 contiguous amino acid additions relative to SEQ ID NO: 5. In other aspects of this embodiment, a BoNT/E comprises a polypeptide having, e.g., at least one, two, three, four, five, six, seven, eight, nine, 10, 20, 30, 40, 50, 100, 200 or 500 contiguous amino acid additions relative to SEQ ID NO: 5.

In another embodiment, a Clostridial toxin comprises a BoNT/F. In an aspect of this embodiment, a BoNT/F comprises a BoNT/F enzymatic domain, a BoNT/F translocation domain and a BoNT/F binding domain. In another aspect of this embodiment, a BoNT/F comprises SEQ ID NO: 6. In another aspect of this embodiment, a BoNT/F comprises a naturally occurring BoNT/F variant, such as, e.g., a BoNT/F isoform or a BoNT/F subtype. In another aspect of this embodiment, a BoNT/F comprises a naturally occurring BoNT/F variant of SEQ ID NO: 6, such as, e.g., a BoNT/F isoform of SEQ ID NO: 6 or a BoNT/F subtype of SEQ ID NO: 6. In still another aspect of this embodiment, a BoNT/F comprises a non-naturally occurring BoNT/F variant, such as, e.g., a conservative BoNT/F variant, a non-conservative BoNT/F variant or an active BoNT/F fragment, or any combination thereof. In still another aspect of this embodiment, a BoNT/F comprises a non-naturally occurring BoNT/F variant of SEQ ID NO: 6, such as, e.g., a conservative BoNT/F variant of SEQ ID NO: 6, a non-conservative BoNT/F variant of SEQ ID NO: 6 or an active BoNT/F fragment of SEQ ID NO: 6, or any combination thereof. In yet another aspect of this embodiment, a BoNT/F comprises a BoNT/F enzymatic domain or active fragment thereof, a BoNT/F translocation domain or active fragment thereof, a BoNT/F binding domain or active fragment thereof, and any combination thereof. In yet another aspect of this embodiment, a BoNT/F comprises a BoNT/F enzymatic domain of amino acid 1-439 from SEQ ID NO: 6 or active fragment thereof, a BoNT/F translocation domain of amino acids 440-864 from SEQ ID NO: 6 or active fragment thereof, a BoNT/F binding domain of amino acids 865-1274 from SEQ ID NO: 6 or active fragment thereof, and any combination thereof.

In other aspects of this embodiment, a BoNT/F comprises a polypeptide having, e.g., at least 70% amino acid identity with SEQ ID NO: 6, at least 75% amino acid identity with the SEQ ID NO: 6, at least 80% amino acid identity with SEQ ID NO: 6, at least 85% amino acid identity with SEQ ID NO: 6, at least 90% amino acid identity with SEQ ID NO: 6 or at least 95% amino acid identity with SEQ ID NO: 6. In yet other aspects of this embodiment, a BoNT/F comprises a polypeptide having, e.g., at most 70% amino acid identity with SEQ ID NO: 6, at most 75% amino acid identity with the SEQ ID NO: 6, at most 80% amino acid identity with SEQ ID NO: 6, at most 85% amino acid identity with SEQ ID NO: 6, at most 90% amino acid identity with SEQ ID NO: 6 or at most 95% amino acid identity with SEQ ID NO: 6.

In other aspects of this embodiment, a BoNT/F comprises a polypeptide having, e.g., at most one, two, three, four, five, six, seven, eight, nine, 10, 20, 30, 40, 50, 100, 200 or 500 non-contiguous amino acid substitutions relative to SEQ ID NO: 6. In other aspects of this embodiment, a BoNT/F comprises a polypeptide having, e.g., at least one, two, three, four, five, six, seven, eight, nine, 10, 20, 30, 40, 50, 100, 200 or 500 non-contiguous amino acid substitutions relative to SEQ ID NO: 6. In yet other aspects of this embodiment, a BoNT/F comprises a polypeptide having, e.g., at most one, two, three, four, five, six, seven, eight, nine, 10, 20, 30, 40, 50, 100, 200 or 500 non-contiguous amino acid deletions relative to SEQ ID NO: 6. In other aspects of this embodiment, a BoNT/F comprises a polypeptide having, e.g., at least one, two, three, four, five, six, seven, eight, nine, 10, 20, 30, 40, 50, 100, 200 or 500 non-contiguous amino acid deletions relative to SEQ ID NO: 6. In still other aspects of this embodiment, a BoNT/F comprises a polypeptide having, e.g., at most one, two, three, four, five, six, seven, eight, nine, 10, 20, 30, 40, 50, 100, 200 or 500 non-contiguous amino acid additions relative to SEQ ID NO: 6. In other aspects of this embodiment, a BoNT/F comprises a polypeptide having, e.g., at least one, two, three, four, five, six, seven, eight, nine, 10, 20, 30, 40, 50, 100, 200 or 500 non-contiguous amino acid additions relative to SEQ ID NO: 6.

In other aspects of this embodiment, a BoNT/F comprises a polypeptide having, e.g., at most one, two, three, four, five, six, seven, eight, nine, 10, 20, 30, 40, 50, 100, 200 or 500 contiguous amino acid substitutions relative to SEQ ID NO: 6. In other aspects of this embodiment, a BoNT/F comprises a polypeptide having, e.g., at least one, two, three, four, five, six, seven, eight, nine, 10, 20, 30, 40, 50, 100, 200 or 500 contiguous amino acid substitutions relative to SEQ ID NO: 6. In yet other aspects of this embodiment, a BoNT/F comprises a polypeptide having, e.g., at most one, two, three, four, five, six, seven, eight, nine, 10, 20, 30, 40, 50, 100, 200 or 500 contiguous amino acid deletions relative to SEQ ID NO: 6. In other aspects of this embodiment, a BoNT/F comprises a polypeptide having, e.g., at least one, two, three, four, five, six, seven, eight, nine, 10, 20, 30, 40, 50, 100, 200 or 500 contiguous amino acid deletions relative to SEQ ID NO: 6. In still other aspects of this embodiment, a BoNT/F comprises a polypeptide having, e.g., at most one, two, three, four, five, six, seven, eight, nine, 10, 20, 30, 40, 50, 100, 200 or 500 contiguous amino acid additions relative to SEQ ID NO: 6. In other aspects of this embodiment, a BoNT/F comprises a polypeptide having, e.g., at least one, two, three, four, five, six, seven, eight, nine, 10, 20, 30, 40, 50, 100, 200 or 500 contiguous amino acid additions relative to SEQ ID NO: 6.

In another embodiment, a Clostridial toxin comprises a BoNT/G. In an aspect of this embodiment, a BoNT/G comprises a BoNT/G enzymatic domain, a BoNT/G translocation domain and a BoNT/G binding domain. In another aspect of this embodiment, a BoNT/G comprises SEQ ID NO: 7. In another aspect of this embodiment, a BoNT/G comprises a naturally occurring BoNT/G variant, such as, e.g., a BoNT/G isoform or a BoNT/G subtype. In another aspect of this embodiment, a BoNT/G comprises a naturally occurring BoNT/G variant of SEQ ID NO: 7, such as, e.g., a BoNT/G isoform of SEQ ID NO: 7 or a BoNT/G subtype of SEQ ID NO: 7. In still another aspect of this embodiment, a BoNT/G comprises a non-naturally occurring BoNT/G variant, such as, e.g., a conservative BoNT/G variant, a non-conservative BoNT/G variant or an active BoNT/G fragment, or any combination thereof. In still another aspect of this embodiment, a BoNT/D comprises a non-naturally occurring BoNT/G variant of SEQ ID NO: 7, such as, e.g., a conservative BoNT/G variant of SEQ ID NO: 7, a non-conservative BoNT/G variant of SEQ ID NO: 7 or an active BoNT/G fragment of SEQ ID NO: 7, or any combination thereof. In yet another aspect of this embodiment, a BoNT/G comprises a BoNT/G enzymatic domain or an active fragment thereof, a BoNT/G translocation domain or an active fragment thereof, a BoNT/G binding domain or an active fragment thereof, or any combination thereof. In yet another aspect of this embodiment, a BoNT/G comprising a BoNT/G enzymatic domain of amino acids 1-446 from SEQ ID NO: 7 or an active fragment thereof, a BoNT/G translocation domain of amino acids 447-863 from SEQ ID NO: 7 or an active fragment thereof, a BoNT/G binding domain of amino acids 864-1297 from SEQ ID NO: 7 or an active fragment thereof, and any combination thereof.

In other aspects of this embodiment, a BoNT/G comprises a polypeptide having, e.g., at least 70% amino acid identity with SEQ ID NO: 7, at least 75% amino acid identity with the SEQ ID NO: 7, at least 80% amino acid identity with SEQ ID NO: 7, at least 85% amino acid identity with SEQ ID NO: 7, at least 90% amino acid identity with SEQ ID NO: 7 or at least 95% amino acid identity with SEQ ID NO: 7. In yet other aspects of this embodiment, a BoNT/G comprises a polypeptide having, e.g., at most 70% amino acid identity with SEQ ID NO: 7, at most 75% amino acid identity with the SEQ ID NO: 7, at most 80% amino acid identity with SEQ ID NO: 7, at most 85% amino acid identity with SEQ ID NO: 7, at most 90% amino acid identity with SEQ ID NO: 7 or at most 95% amino acid identity with SEQ ID NO: 7.

In other aspects of this embodiment, a BoNT/G comprises a polypeptide having, e.g., at most one, two, three, four, five, six, seven, eight, nine, 10, 20, 30, 40, 50, 100, 200 or 500 non-contiguous amino acid substitutions relative to SEQ ID NO: 7. In other aspects of this embodiment, a BoNT/G comprises a polypeptide having, e.g., at least one, two, three, four, five, six, seven, eight, nine, 10, 20, 30, 40, 50, 100, 200 or 500 non-contiguous amino acid substitutions relative to SEQ ID NO: 7. In yet other aspects of this embodiment, a BoNT/G comprises a polypeptide having, e.g., at most one, two, three, four, five, six, seven, eight, nine, 10, 20, 30, 40, 50, 100, 200 or 500 non-contiguous amino acid deletions relative to SEQ ID NO: 7. In other aspects of this embodiment, a BoNT/G comprises a polypeptide having, e.g., at least one, two, three, four, five, six, seven, eight, nine, 10, 20, 30, 40, 50, 100, 200 or 500 non-contiguous amino acid deletions relative to SEQ ID NO: 7. In still other aspects of this embodiment, a BoNT/G comprises a polypeptide having, e.g., at most one, two, three, four, five, six, seven, eight, nine, 10, 20, 30, 40, 50, 100, 200 or 500 non-contiguous amino acid additions relative to SEQ ID NO: 7. In other aspects of this embodiment, a BoNT/G comprises a polypeptide having, e.g., at least one, two, three, four, five, six, seven, eight, nine, 10, 20, 30, 40, 50, 100, 200 or 500 non-contiguous amino acid additions relative to SEQ ID NO: 7.

In other aspects of this embodiment, a BoNT/G comprises a polypeptide having, e.g., at most one, two, three, four, five, six, seven, eight, nine, 10, 20, 30, 40, 50, 100, 200 or 500 contiguous amino acid substitutions relative to SEQ ID NO: 7. In other aspects of this embodiment, a BoNT/G comprises a polypeptide having, e.g., at least one, two, three, four, five, six, seven, eight, nine, 10, 20, 30, 40, 50, 100, 200 or 500 contiguous amino acid substitutions relative to SEQ ID NO: 7. In yet other aspects of this embodiment, a BoNT/G comprises a polypeptide having, e.g., at most one, two, three, four, five, six, seven, eight, nine, 10, 20, 30, 40, 50, 100, 200 or 500 contiguous amino acid deletions relative to SEQ ID NO: 7. In other aspects of this embodiment, a BoNT/G comprises a polypeptide having, e.g., at least one, two, three, four, five, six, seven, eight, nine, 10, 20, 30, 40, 50, 100, 200 or 500 contiguous amino acid deletions relative to SEQ ID NO: 7. In still other aspects of this embodiment, a BoNT/G comprises a polypeptide having, e.g., at most one, two, three, four, five, six, seven, eight, nine, 10, 20, 30, 40, 50, 100, 200 or 500 contiguous amino acid additions relative to SEQ ID NO: 7. In other aspects of this embodiment, a BoNT/G comprises a polypeptide having, e.g., at least one, two, three, four, five, six, seven, eight, nine, 10, 20, 30, 40, 50, 100, 200 or 500 contiguous amino acid additions relative to SEQ ID NO: 7.

In another embodiment, a Clostridial toxin comprises a TeNT. In an aspect of this embodiment, a TeNT comprises a TeNT enzymatic domain, a TeNT translocation domain and a TeNT binding domain. In an aspect of this embodiment, a TeNT comprises SEQ ID NO: 8. In another aspect of this embodiment, a TeNT comprises a naturally occurring TeNT variant, such as, e.g., a TeNT isoform or a TeNT subtype. In another aspect of this embodiment, a TeNT comprises a naturally occurring TeNT variant of SEQ ID NO: 8, such as, e.g., a TeNT isoform of SEQ ID NO: 8 or a TeNT subtype of SEQ ID NO: 8. In still another aspect of this embodiment, a TeNT comprises a non-naturally occurring TeNT variant, such as, e.g., a conservative TeNT variant, a non-conservative TeNT variant or an active TeNT fragment, or any combination thereof. In still another aspect of this embodiment, a TeNT comprises a non-naturally occurring TeNT variant of SEQ ID NO: 8, such as, e.g., a conservative TeNT variant of SEQ ID NO: 8, a non-conservative TeNT variant of SEQ ID NO: 8 or an active TeNT fragment of SEQ ID NO: 8, or any combination thereof. In yet another aspect of this embodiment, a TeNT comprising a TeNT enzymatic domain or an active fragment thereof, a TeNT translocation domain or active fragment thereof, a TeNT binding domain or active fragment thereof, and any combination thereof. In yet another aspect of this embodiment, a TeNT comprising a TeNT enzymatic domain of amino acids 1-457 from SEQ ID NO: 8 or active fragment thereof, a TeNT translocation domain of amino acids 458-879 from SEQ ID NO: 8 or active fragment thereof, a TeNT binding domain of amino acids 880-1315 from SEQ ID NO: 8 or active fragment thereof, and any combination thereof.

In other aspects of this embodiment, a TeNT comprises a polypeptide having, e.g., at least 70% amino acid identity with SEQ ID NO: 8, at least 75% amino acid identity with the SEQ ID NO: 8, at least 80% amino acid identity with SEQ ID NO: 8, at least 85% amino acid identity with SEQ ID NO: 8, at least 90% amino acid identity with SEQ ID NO: 8 or at least 95% amino acid identity with SEQ ID NO: 8. In yet other aspects of this embodiment, a TeNT comprises a polypeptide having, e.g., at most 70% amino acid identity with SEQ ID NO: 8, at most 75% amino acid identity with the SEQ ID NO: 8, at most 80% amino acid identity with SEQ ID NO: 8, at most 85% amino acid identity with SEQ ID NO: 8, at most 90% amino acid identity with SEQ ID NO: 8 or at most 95% amino acid identity with SEQ ID NO: 8.

In other aspects of this embodiment, a TeNT comprises a polypeptide having, e.g., at most one, two, three, four, five, six, seven, eight, nine, 10, 20, 30, 40, 50, 100, 200 or 500 non-contiguous amino acid substitutions relative to SEQ ID NO: 8. In other aspects of this embodiment, a TeNT comprises a polypeptide having, e.g., at least one, two, three, four, five, six, seven, eight, nine, 10, 20, 30, 40, 50, 100, 200 or 500 non-contiguous amino acid substitutions relative to SEQ ID NO: 8. In yet other aspects of this embodiment, a TeNT comprises a polypeptide having, e.g., at most one, two, three, four, five, six, seven, eight, nine, 10, 20, 30, 40, 50, 100, 200 or 500 non-contiguous amino acid deletions relative to SEQ ID NO: 8. In other aspects of this embodiment, a TeNT comprises a polypeptide having, e.g., at least one, two, three, four, five, six, seven, eight, nine, 10, 20, 30, 40, 50, 100, 200 or 500 non-contiguous amino acid deletions relative to SEQ ID NO: 8. In still other aspects of this embodiment, a TeNT comprises a polypeptide having, e.g., at most one, two, three, four, five, six, seven, eight, nine, 10, 20, 30, 40, 50, 100, 200 or 500 non-contiguous amino acid additions relative to SEQ ID NO: 8. In other aspects of this embodiment, a TeNT comprises a polypeptide having, e.g., at least one, two, three, four, five, six, seven, eight, nine, 10, 20, 30, 40, 50, 100, 200 or 500 non-contiguous amino acid additions relative to SEQ ID NO: 8.

In other aspects of this embodiment, a TeNT comprises a polypeptide having, e.g., at most one, two, three, four, five, six, seven, eight, nine, 10, 20, 30, 40, 50, 100, 200 or 500 contiguous amino acid substitutions relative to SEQ ID NO: 8. In other aspects of this embodiment, a TeNT comprises a polypeptide having, e.g., at least one, two, three, four, five, six, seven, eight, nine, 10, 20, 30, 40, 50, 100, 200 or 500 contiguous amino acid substitutions relative to SEQ ID NO: 8. In yet other aspects of this embodiment, a TeNT comprises a polypeptide having, e.g., at most one, two, three, four, five, six, seven, eight, nine, 10, 20, 30, 40, 50, 100, 200 or 500 contiguous amino acid deletions relative to SEQ ID NO: 8. In other aspects of this embodiment, a TeNT comprises a polypeptide having, e.g., at least one, two, three, four, five, six, seven, eight, nine, 10, 20, 30, 40, 50, 100, 200 or 500 contiguous amino acid deletions relative to SEQ ID NO: 8. In still other aspects of this embodiment, a TeNT comprises a polypeptide having, e.g., at most one, two, three, four, five, six, seven, eight, nine, 10, 20, 30, 40, 50, 100, 200 or 500 contiguous amino acid additions relative to SEQ ID NO: 8. In other aspects of this embodiment, a TeNT comprises a polypeptide having, e.g., at least one, two, three, four, five, six, seven, eight, nine, 10, 20, 30, 40, 50, 100, 200 or 500 contiguous amino acid additions relative to SEQ ID NO: 8.

Aspects of the present invention provide, in part, a PAR ligand domain. As used herein, the term "PAR ligand domain" is synonymous with "tethered ligand" and "activating peptide" and means any polypeptide that can selectively bind to the PAR ligand binding domain and initiate the overall internalization mechanism whereby an activated PAR is internalized into a cell. As used herein, the term "selectively" means having a unique effect or influence or reacting in only one way or with only one thing. As used herein, the term "selectively bind" means that a PAR ligand domain is able to bind its target PAR ligand binding domain under physiological conditions, or in vitro conditions substantially approximating physiological conditions, to a statistically significantly greater degree (i.e., has a smaller Kd or dissociation constant) than to other, non-target ligand binding domains. "Kd" is the molar concentration of the PAR ligand domain at which half the PAR ligand binding domains are bound by the PAR ligand domain. Thus, there is a discriminatory binding of the PAR ligand domain to the indicated target binding site.

Most G protein-coupled receptors (GPCRs) are reversibly activated upon ligand binding. However, activation of protease-activated G protein-coupled receptors (PARs) occurs through an irreversible proteolytic event that results in the generation of a tethered ligand that cannot diffuse away. In essence, PARs are receptors that carry their own ligands, which remain unbound until unmasked by site-specific receptor cleavage. The coagulant protease Thrombin is the physiological activator of PAR1, PAR3 and PAR4; however, other proteases can cleave these receptors and may contribute to their function in vivo (Table 2). PAR2 is activated by multiple Trypsin-like serine proteases including Trypsin, Tryptase and coagulation proteases upstream of Thrombin, Factors Vila and Xa, but not by Thrombin (Table 2).

Currently four subtypes of human PARs are described and designated PAR1 (SEQ ID NO: 9), PAR2 (SEQ ID NO: 10), PAR3 (SEQ ID NO: 11) and PAR4 (SEQ ID NO: 12). In addition, PAR1, PAR2, PAR3 and PAR4 orthologs which exhibit at least 70% amino acid identity and at least 80% amino acid similarity have been identified in other mammals, such as, e.g., the chimpanzee *Pan troglodytes*, the hamadryas baboon *Papio hamadryas*, the dog *Canis familiaris*, the mouse *Mus musculus*, the rat *Rattus norvegicus* and the chicken *Gallus gallus*. The protease cleavage site, which upon cleavage unmasks the tethered ligand, is known for all four receptors (Table 2). In human PARs, cleavage of PAR1 at R41-S42 exposes a new amino terminus ending in the hexapeptide SFLLRN (SEQ ID NO: 13), cleavage of PAR2 at R34-S35 exposes a new amino terminus ending in the hexapeptide SLIGKV (SEQ ID NO: 24), cleavage of PAR3 at K38-T39 exposes a new amino terminus ending in the hexapeptide TFRGAP (SEQ ID NO: 26), where as, cleavage of PAR4 at R47-G48 exposes a new amino terminus ending in the hexapeptide GYPGQV (SEQ ID NO: 28). A hirudin-like site distal to the protease cleavage site has been described in PAR1 and PAR3. This charged domain appears to help mediate the binding of Thrombin to PAR1, thereby facilitating cleavage of the protease cleavage site.

TABLE 2

Summary of the Human PAR Family

| | PAR1 | PAR2 | PAR3 | PAR4 |
|---|---|---|---|---|
| Endogenous Activating proteases | APC<br>Factor Xa<br>Thrombin<br>Trypsins | Acrosien<br>Factor Xa<br>Factor VIIa<br>MT-SP1<br>Proteinase-3<br>Trypsins<br>Tryptases | Thrombin | Cathepsin G<br>Factor Xa<br>Factor VIIa<br>Plasmin<br>Thrombin<br>Trypsins |

TABLE 2-continued

Summary of the Human PAR Family

|  | PAR1 | PAR2 | PAR3 | PAR4 |
|---|---|---|---|---|
| Exogenous Activating proteases | Granzyme A Gingipains-R | Der P1 Der P3 Der P9 Gingipains-R |  | Gingipains-R |
| Inactivating proteases | Cathepsin G Elastase Plasmin Proteinase-3 Trypsins | Cathepsin G Elastase | Cathepsin G |  |
| Cleavage site Localization | LDPR$^{41}$*S$^{42}$FLLRN platelets endothelium epithelium fibroblasts myocytes neurons astrocytes | SKGR$^{34}$*S$^{35}$LIGKV epithelium endothelium fibroblasts myocytes neurons astrocytes | LPIK$^{38}$*T$^{39}$FRGAP platelets endothelium myocytes astrocytes | PAPR$^{47}$*G$^{48}$YPGQV platelets endothelium myocytes astrocytes |

An asterisks (*) indicates the peptide bond that is cleaved by an activating PAR protease.

Synthetic peptides representing the newly formed amino terminus tethered ligand of PARs can act as agonists for the receptor without the need for proteolysis and can initiate many of the same signaling responses elicited by proteolytically activated PARs (Table 3), see e.g., Shaun R. Coughlin and Mark Kahn, *Modulation of Platelet Activation*, PCT Patent Publication WO 01/07072 (Feb. 1, 2001); Shaun R. Coughlin and Tatjana R. Faruqi, *Peptides Modulating Protease Activated Receptors and Methods of Using Same*, PCT Patent Publication WO 01/94411 (Dec. 13, 2001); Scott R. MacFarlane et al., *Protease-Activated Receptors*, 53(2) Pharmacol. Rev. 245-282 (2001); and Robert M. Scarborough, *Protease-Activated Receptor-2 Antagonists and Agonists*, 1(1) Curr. Med. Chem. Cardiovasc. Hematol. Agents 73-82 (2003). Referred to as activating peptides (AP), these peptides evoke the ligand binding, the signal transduction and the signal termination steps described above. The first described AP was the 14-residue peptide SFLLRNPNDKYEPF comprising amino acids 42-55 of SEQ ID NO: 9 that behaves as an agonist for PAR1. Subsequent work has shown that not only the hexapeptide SFLLRN (SEQ ID NO: 13), but a wide range of variants were also effective, if not fully functional to elicit a cellular response (Table 3). Analysis of PAR APs using alanine scanning and site-directed mutagenesis has identified residues critical for function. For example, the residues F2, L4 and R5 are functionally important for the PAR1 AP hexapeptide SFLLRN (SEQ ID NO: 13), but substitutions of residues at other positions can be tolerated. Similar testing of the PAR2 AP hexapeptide SLIGKV indicates that L2 and R5 are essential for PAR2 AP activity whereas substitution of G4 or L6 has only a slight effect on PAR2 activation. Replacing S1 or I3 with alanine also reduces activity. While many PAR4 variants are functional (Table 3), the specificity of PAR4 AP requires Y2, since replacement with F generates an agonist of both PAR1 and PAR4.

TABLE 3

PAR Binding Domains

| | Amino Acid Sequence | SEQ ID NO: |
|---|---|---|
| PAR1 | | |
| Reference | SFLLRN | 13 |
| Variants | SFFLRN | 14 |
| | SFFLKN | 133 |
| | TFLLRN | 15 |
| | GFPGKF | 16 |
| | GYPAKF | 17 |
| | GYPLKF | 18 |
| | GYPIKF | 19 |
| | G(F)PGKF | 20 |
| | GYP(Cha)KF | 21 |
| | S(F)(Cha)(Cha)RK | 22 |
| | S(F)(Cha)(Cha)(homoR)K | 23 |
| PAR2 | | |
| Reference | SLIGKV | 24 |
| Variants | SLIGRL | 25 |
| PAR3 | | |
| Reference | TFRGAP | 26 |
| Variants | SFNGGP | 27 |
| | SFNGNE | 134 |
| PAR4 | | |
| Reference | GYPGQV | 28 |
| Variants | AYPGKF | 29 |
| | TYPGKF | 30 |
| | GYPGKY | 31 |
| | GYPGKW | 32 |
| | GYPGKK | 33 |
| | GYPGKF | 34 |
| | GYPGRF | 35 |
| | GYPGFK | 36 |
| | GYPAKF | 37 |
| | GFPGKF | 38 |
| | GFPGKP | 39 |
| | SYPGKF | 40 |
| | SYPAKF | 41 |
| | SYPGRF | 42 |
| | SYAGKF | 43 |
| | SFPGQP | 135 |
| | SFPGQA | 160 |
| | GYPG(Orn)F | 44 |

TABLE 3-continued

PAR Binding Domains

| Amino Acid Sequence | SEQ ID NO: |
|---|---|
| G(F)PGKF | 45 |
| GYPG(homoR)F | 46 |
| SYPG(homoR)F | 47 |

(Cha), cyclohexylalanine; (homoR), homoarginine; (Orn), ornithine; (F), parafluoro-phenylalanine; other letters represent the single letter amino acid code.

It is envisioned that any and all PAR ligand domains capable of binding an inactivated PAR and eliciting the internalization of the modified Clostridial toxin-PAR complex into a cell can be useful in aspects of the present invention. It is envisioned that a PAR ligand domain of any and all lengths can be useful in aspects of the present invention with the proviso that the PAR ligand domain is capable of binding an inactivated PAR and eliciting the internalization of the modified Clostridial toxin-PAR complex into a cell. Thus, in aspects of this embodiment, a PAR ligand domain can be, e.g., at least 6 amino acids in length, at least 7 amino acids in length, at least 8 amino acids in length, at least 9 amino acids in length, at least 10 amino acids in length, at least 15 amino acids in length, at least 20 amino acids in length, at least 25 amino acids in length, at least 30 amino acids in length, at least 40 amino acids in length, at least 50 amino acids in length or at least 60 amino acids in length. In other aspects of this embodiment, a PAR ligand domain can be, e.g., at most 6 amino acids in length, at most 7 amino acids in length, at most 8 amino acids in length, at most 9 amino acids in length, at most 10 amino acids in length, at most 15 amino acids in length, at most 20 amino acids in length, at most 25 amino acids in length, at most 30 amino acids in length, at most 40 amino acids in length, at most 50 amino acids in length or at most 60 amino acids in length. As a non-limiting example, a PAR 1 ligand domain can comprise amino acids 1-64 of SEQ ID NO: 9, amino acids 1-55 of SEQ ID NO: 9, amino acids 1-47 of SEQ ID NO: 9, amino acids 29-64 of SEQ ID NO: 9, amino acids 42-55 of SEQ ID NO: 9 or amino acids 42-47 of SEQ ID NO: 9. As another non-limiting example, a PAR 2 ligand domain can comprise amino acids 1-59 of SEQ ID NO: 10, comprise amino acids 1-48 of SEQ ID NO: 10, comprise amino acids 1-40 of SEQ ID NO: 10, amino acids 24-59 of SEQ ID NO: 10, amino acids 35-48 of SEQ ID NO: 10 or amino acids 35-40 of SEQ ID NO: 10. As still another non-limiting example, a PAR 3 ligand domain can comprise amino acids 1-60 of SEQ ID NO: 11, comprise amino acids 1-52 of SEQ ID NO: 11, comprise amino acids 1-44 of SEQ ID NO: 11, amino acids 26-60 of SEQ ID NO: 11, amino acids 39-52 of SEQ ID NO: 11 or amino acids 39-44 of SEQ ID NO: 11. As yet another non-limiting example, a PAR 4 ligand domain can comprise amino acids 1-70 of SEQ ID NO: 12, comprise amino acids 1-61 of SEQ ID NO: 12, comprise amino acids 1-53 of SEQ ID NO: 12, amino acids 35-70 of SEQ ID NO: 12, amino acids 48-61 of SEQ ID NO: 12 or amino acids 48-53 of SEQ ID NO: 12.

A PAR ligand domain useful in aspects of the invention includes, without limitation, naturally occurring PAR ligand domains, such as, e.g., a PAR1 tethered ligand, a PAR2 tethered ligand, a PAR3 tethered ligand or a PAR4 tethered ligand; naturally occurring PAR ligand domain variants; and non-naturally-occurring PAR ligand domain variants, such as, e.g., conservative PAR ligand domain variants, non-conservative PAR ligand domain variants and PAR ligand domain peptidomimetics. As used herein, the term "PAR ligand domain variant," whether naturally-occurring or non-naturally-occurring, means a PAR ligand domain that has at least one amino acid change from the corresponding region of the disclosed reference sequences and can be described in percent identity to the corresponding region of that reference sequence (Table 3). Any of a variety of sequence alignment methods can be used to determine percent identity, including, without limitation, global methods, local methods and hybrid methods, such as, e.g., segment approach methods. Protocols to determine percent identity are routine procedures within the scope of one skilled in the art and from the teaching herein.

As used herein, the term "naturally occurring PAR ligand domain variant" means any PAR ligand domain produced without the aid of any human manipulation, including, without limitation, PAR ligand domain isoforms produced from alternatively-spliced transcripts, PAR ligand domain isoforms produced by spontaneous mutation and PAR ligand domain subtypes.

As used herein, the term "non-naturally occurring PAR ligand domain variant" means any PAR ligand domain produced with the aid of human manipulation, including, without limitation, PAR ligand domain variants produced by genetic engineering using random mutagenesis or rational design and PAR ligand domain variants produced by chemical synthesis. Non-limiting examples of non-naturally occurring PAR ligand domain variant include, e.g., conservative PAR ligand domain variants, non-conservative PAR ligand domain variants and PAR ligand domain peptidomimetics.

As used herein, the term "conservative PAR ligand domain variant" means a PAR ligand domain that has at least one amino acid substituted by another amino acid or an amino acid analog that has at least one property similar to that of the original amino acid from the reference PAR ligand domain sequence (Table 3). Examples of properties include, without limitation, similar size, topography, charge, hydrophobicity, hydrophilicity, lipophilicity, covalent-bonding capacity, hydrogen-bonding capacity, a physicochemical property, of the like, or any combination thereof. A conservative PAR ligand domain variant can function in substantially the same manner as the reference PAR ligand domain on which the conservative PAR ligand domain variant is based, and can be substituted for the reference PAR ligand domain in any aspect of the present invention. A conservative PAR ligand domain variant may substitute one or more amino acids, two or more amino acids, three or more amino acids, four or more amino acids or five or more amino acids from the reference PAR ligand domain on which the conservative PAR ligand domain variant is based. A conservative PAR ligand domain variant can also possess at least 50% amino acid identity, 65% amino acid identity, 75% amino acid identity, 85% amino acid identity or 95% amino acid identity to the reference PAR ligand domain on which the conservative PAR ligand domain variant is based. Non-limiting examples of a conservative PAR ligand domain variant include, e.g., conservative PAR1 ligand domain variants, conservative PAR2 ligand domain variants, conservative PAR3 ligand domain variants and conservative PAR4 ligand domain variants.

As used herein, the term "non-conservative PAR ligand domain variant" means a PAR ligand domain in which 1) at least one amino acid is deleted from the reference PAR ligand domain on which the non-conservative PAR ligand domain variant is based; 2) at least one amino acid added to the reference PAR ligand domain on which the non-conservative PAR ligand domain is based; or 3) at least one amino acid is substituted by another amino acid or an amino acid analog that does not share any property similar to that of the original amino acid from the reference PAR ligand domain sequence (Table 3). A non-conservative PAR ligand domain variant can function in substantially the same manner as the reference PAR ligand domain on which the non-conservative PAR ligand domain is based, and can be substituted for the reference PAR ligand domain in any aspect of the present invention. A non-conservative PAR ligand domain variant can add one or more amino acids, two or more amino acids, three or more amino acids, four or more amino acids, five or more amino acids, and ten or more amino acids to the reference PAR ligand domain on which the non-conservative PAR ligand domain variant is based. A non-conservative PAR ligand domain may substitute one or more amino acids, two or more amino acids, three or more amino acids, four or more amino acids or five or more amino acids from the reference PAR ligand domain on which the non-conservative PAR ligand domain variant is based. A non-conservative PAR ligand domain variant can also possess at least 50% amino acid identity, 65% amino acid identity, 75% amino acid identity, 85% amino acid identity or 95% amino acid identity to the reference PAR ligand domain on which the non-conservative PAR ligand domain variant is based. Non-limiting examples of a non-conservative PAR ligand domain variant include, e.g., non-conservative PAR1 ligand domain variants, non-conservative PAR2 ligand domain variants, non-conservative PAR3 ligand domain variants and non-conservative PAR4 ligand domain variants.

As used herein, the term "PAR ligand domain peptidomimetic" means a PAR ligand domain that has at least one amino acid substituted by a non-natural oligomer that has at least one property similar to that of the first amino acid. Examples of properties include, without limitation, topography of a peptide primary structural element, functionality of a peptide primary structural element, topology of a peptide secondary structural element, functionality of a peptide secondary structural element, of the like, or any combination thereof. A PAR ligand domain peptidomimetic can function in substantially the same manner as the reference PAR ligand domain on which the PAR ligand domain peptidomimetic is based, and can be substituted for the reference PAR ligand domain in any aspect of the present invention. A PAR ligand domain peptidomimetic may substitute one or more amino acids, two or more amino acids, three or more amino acids, four or more amino acids or five or more amino acids from the reference PAR ligand domain on which the PAR ligand domain peptidomimetic is based. A PAR ligand domain peptidomimetic can also possess at least 50% amino acid identity, at least 65% amino acid identity, at least 75% amino acid identity, at least 85% amino acid identity or at least 95% amino acid identity to the reference PAR ligand domain on which the PAR ligand domain peptidomimetic is based. For examples of peptidomimetic methods see, e.g., Amy S. Ripka & Daniel H. Rich, Peptidomimetic design, 2(4) CURR. OPIN. CHEM. BIOL. 441-452 (1998); and M. Angels Estiarte & Daniel H. Rich, *Peptidomimetics for Drug Design*, 803-861 (BURGER'S MEDICINAL CHEMISTRY AND DRUG DISCOVERY Vol. 1 PRINCIPLE AND PRACTICE, Donald J. Abraham ed., Wiley-Interscience, 6$^{th}$ ed 2003). Non-limiting examples of a PAR ligand domain peptidomimetic include, e.g., PAR1 ligand domain peptidomimetics, PAR2 ligand domain peptidomimetics, PAR3 ligand domain peptidomimetics and PAR4 ligand domain peptidomimetics.

Thus, in an embodiment, a PAR ligand domain comprises a naturally occurring PAR ligand domain variant, such as, e.g., a PAR ligand domain isoform or a PAR ligand domain subtype. In another embodiment a PAR ligand domain comprises a non-naturally occurring PAR ligand domain variant, such as, e.g., a conservative PAR ligand domain variant, a non-conservative PAR ligand domain variant or a PAR ligand domain peptidomimetic, or any combination thereof.

In another embodiment, a PAR ligand domain comprises a PAR1 ligand domain. In an aspect of this embodiment, a PAR1 ligand domain comprises SEQ ID NO: 13. In another aspect of this embodiment, a PAR1 ligand domain comprises a naturally occurring PAR1 ligand domain variant, such as, e.g., a PAR1 ligand domain isoform or a PAR1 ligand domain subtype. In another aspect of this embodiment, a PAR1 ligand domain comprises a naturally occurring PAR1 ligand domain variant of SEQ ID NO: 13, such as, e.g., a PAR1 ligand domain isoform of SEQ ID NO: 13 or a PAR1 ligand domain subtype of SEQ ID NO: 13. In still another aspect of this embodiment, a PAR1 ligand domain comprises a non-naturally occurring PAR1 ligand domain variant, such as, e.g., a conservative PAR1 ligand domain variant, a non-conservative PAR1 ligand domain variant or a PAR1 ligand domain peptidomimetic, or any combination thereof. In still another aspect of this embodiment, a PAR1 ligand domain comprises a non-naturally occurring PAR1 ligand domain variant of SEQ ID NO: 13, such as, e.g., a conservative PAR1 ligand domain variant of SEQ ID NO: 13, a non-conservative PAR1 ligand domain variant of SEQ ID NO: 13 or a PAR1 ligand domain peptidomimetic of SEQ ID NO: 13, or any combination thereof. In other aspects of this embodiment, a PAR1 ligand domain comprises SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23 or SEQ ID NO: 133.

In other aspects of this embodiment, a PAR1 ligand domain comprises a polypeptide having, e.g., at least 50% amino acid identity with SEQ ID NO: 13, at least 67% amino acid identity with the SEQ ID NO: 13, or at least 83% amino acid identity with SEQ ID NO: 13. In still other aspects of this embodiment, a PAR1 ligand domain comprises a polypeptide having, e.g., at most 50% amino acid identity with SEQ ID NO: 13, at most 67% amino acid identity with the SEQ ID NO: 13, at most 83% amino acid identity with SEQ ID NO: 13.

In other aspects of this embodiment, a PAR1 ligand domain comprises a polypeptide having, e.g., at most one, two, three or four non-contiguous amino acid substitutions relative to SEQ ID NO: 13. In still other aspects of this embodiment, a PAR1 ligand domain comprises a polypeptide having, e.g., at least one, two, three or four non-contiguous amino acid substitutions relative to SEQ ID NO: 13. In yet other aspects of this embodiment, a PAR1 ligand domain comprises a polypeptide having, e.g., at most one, two, three, four, five, six, seven, eight, nine or ten non-contiguous amino acid additions relative to SEQ ID NO: 13. In yet other aspects of this embodiment, a PAR1 ligand domain comprises a polypeptide having, e.g., at least one, two, three, four, five, six, seven, eight, nine or ten non-contiguous amino acid additions relative to SEQ ID NO: 13. In still other aspects of this embodiment, a PAR1 ligand domain comprises a polypeptide having, e.g., at most one, two or three non-contiguous amino acid deletions relative to SEQ ID NO: 13. In still other aspects of this embodiment, a PAR1 ligand domain comprises a polypeptide having, e.g., at least one, two or three non-contiguous amino acid deletions relative to SEQ ID NO: 13.

In other aspects of this embodiment, a PAR1 ligand domain comprises a polypeptide having, e.g., at most two, three or four contiguous amino acid substitutions relative to SEQ ID NO: 13. In still other aspects of this embodiment, a PAR1 ligand domain comprises a polypeptide having, e.g., at least two, three or four contiguous amino acid substitutions relative to SEQ ID NO: 13. In yet other aspects of this embodiment, a PAR1 ligand domain comprises a polypeptide having, e.g., at most two, three, four, five, six, seven, eight, nine or ten contiguous amino acid additions relative to SEQ ID NO: 13. In yet other aspects of this embodiment, a PAR1 ligand domain comprises a polypeptide having, e.g., at least two, three, four, five, six, seven, eight, nine or ten contiguous amino acid additions relative to SEQ ID NO: 13. In still other aspects of this embodiment, a PAR1 ligand domain comprises a polypeptide having, e.g., at most two or three contiguous amino acid deletions relative to SEQ ID NO: 13. In still other aspects of this embodiment, a PAR1 ligand domain comprises a polypeptide having, e.g., at least two or three contiguous amino acid deletions relative to SEQ ID NO: 13.

In another embodiment, a PAR ligand domain comprises a PAR2 ligand domain. In an aspect of this embodiment, a PAR2 ligand domain comprises SEQ ID NO: 24. In another aspect of this embodiment, a PAR2 ligand domain comprises a naturally occurring PAR2 ligand domain variant, such as, e.g., a PAR2 ligand domain isoform or a PAR2 ligand domain subtype. In another aspect of this embodiment, a PAR2 ligand domain comprises a naturally occurring PAR2 ligand domain variant of SEQ ID NO: 24, such as, e.g., a PAR2 ligand domain isoform of SEQ ID NO: 24 or a PAR2 ligand domain subtype of SEQ ID NO: 24. In still another aspect of this embodiment, a PAR2 ligand domain comprises a non-naturally occurring PAR2 ligand domain variant, such as, e.g., a conservative PAR2 ligand domain variant, a non-conservative PAR2 ligand domain variant or a PAR2 ligand domain peptidomimetic, or any combination thereof. In still another aspect of this embodiment, a PAR2 ligand domain comprises a non-naturally occurring PAR2 ligand domain variant of SEQ ID NO: 24, such as, e.g., a conservative PAR2 ligand domain variant of SEQ ID NO: 24, a non-conservative PAR2 ligand domain variant of SEQ ID NO: 24 or a PAR2 ligand domain peptidomimetic of SEQ ID NO: 24, or any combination thereof. In other aspects of this embodiment, a PAR2 ligand domain comprises SEQ ID NO: 24 or SEQ ID NO: 25.

In other aspects of this embodiment, a PAR2 ligand domain comprises a polypeptide having, e.g., at least 50% amino acid identity with SEQ ID NO: 24, at least 67% amino acid identity with the SEQ ID NO: 24, or at least 83% amino acid identity with SEQ ID NO: 24. In still other aspects of this embodiment, a PAR2 ligand domain comprises a polypeptide having, e.g., at most 50% amino acid identity with SEQ ID NO: 24, at most 67% amino acid identity with the SEQ ID NO: 24, at most 83% amino acid identity with SEQ ID NO: 24.

In other aspects of this embodiment, a PAR2 ligand domain comprises a polypeptide having, e.g., at most one, two, three or four non-contiguous amino acid substitutions relative to SEQ ID NO: 24. In still other aspects of this embodiment, a PAR2 ligand domain comprises a polypeptide having, e.g., at least one, two, three or four non-contiguous amino acid substitutions relative to SEQ ID NO: 24. In yet other aspects of this embodiment, a PAR2 ligand domain comprises a polypeptide having, e.g., at most one, two, three, four, five, six, seven, eight, nine or ten non-contiguous amino acid additions relative to SEQ ID NO: 24. In yet other aspects of this embodiment, a PAR2 ligand domain comprises a polypeptide having, e.g., at least one, two, three, four, five, six, seven, eight, nine or ten non-contiguous amino acid additions relative to SEQ ID NO: 24. In still other aspects of this embodiment, a PAR2 ligand domain comprises a polypeptide having, e.g., at most one, two or three non-contiguous amino acid deletions relative to SEQ ID NO: 24. In still other aspects of this embodiment, a PAR2 ligand domain comprises a polypeptide having, e.g., at least one, two or three non-contiguous amino acid deletions relative to SEQ ID NO: 24.

In other aspects of this embodiment, a PAR2 ligand domain comprises a polypeptide having, e.g., at most one, two, three or four contiguous amino acid substitutions relative to SEQ ID NO: 24. In still other aspects of this embodiment, a PAR2 ligand domain comprises a polypeptide having, e.g., at least two, three or four contiguous amino acid substitutions relative to SEQ ID NO: 24. In yet other aspects of this embodiment, a PAR2 ligand domain comprises a polypeptide having, e.g., at most two, three, four, five, six, seven, eight, nine or ten contiguous amino acid additions relative to SEQ ID NO: 24. In yet other aspects of this embodiment, a PAR2 ligand domain comprises a polypeptide having, e.g., at least two, three, four, five, six, seven, eight, nine or ten contiguous amino acid additions relative to SEQ ID NO: 24. In still other aspects of this embodiment, a PAR2 ligand domain comprises a polypeptide having, e.g., at most two or three contiguous amino acid deletions relative to SEQ ID NO: 24. In still other aspects of this embodiment, a PAR2 ligand domain comprises a polypeptide having, e.g., at least two or three contiguous amino acid deletions relative to SEQ ID NO: 24.

In another embodiment, a PAR ligand domain comprises a PAR3 ligand domain. In an aspect of this embodiment, a PAR3 ligand domain comprises SEQ ID NO: 26. In another aspect of this embodiment, a PAR3 ligand domain comprises a naturally occurring PAR3 ligand domain variant, such as, e.g., a PAR3 ligand domain isoform or a PAR3 ligand domain subtype. In another aspect of this embodiment, a PAR3 ligand domain comprises a naturally occurring PAR3 ligand domain variant of SEQ ID NO: 26, such as, e.g., a PAR3 ligand domain isoform of SEQ ID NO: 26 or a PAR3 ligand domain subtype of SEQ ID NO: 26. In still another aspect of this embodiment, a PAR3 ligand domain comprises a non-naturally occurring PAR3 ligand domain variant, such as, e.g., a conservative PAR3 ligand domain variant, a non-conservative PAR3 ligand domain variant or a PAR3 ligand domain peptidomimetic, or any combination thereof. In still another aspect of this embodiment, a PAR3 ligand domain comprises a non-naturally occurring PAR3 ligand domain variant of SEQ ID NO: 26, such as, e.g., a conservative PAR3 ligand domain variant of SEQ ID NO: 26, a non-conservative PAR3 ligand domain variant of SEQ ID NO: 26 or a PAR3 ligand domain peptidomimetic of SEQ ID NO: 26, or any combination thereof. In other aspects of this embodiment, a PAR3 ligand domain comprises SEQ ID NO: 26, SEQ ID NO: 27 or SEQ ID NO: 134.

In other aspects of this embodiment, a PAR3 ligand domain comprises a polypeptide having, e.g., at least 50% amino acid identity with SEQ ID NO: 26, at least 67% amino acid identity with the SEQ ID NO: 26, or at least 83% amino acid identity with SEQ ID NO: 26. In still other aspects of this embodiment, a PAR3 ligand domain comprises a polypeptide having, e.g., at most 50% amino acid identity with SEQ ID NO: 26, at most 67% amino acid identity with the SEQ ID NO: 26, at most 83% amino acid identity with SEQ ID NO: 26.

In other aspects of this embodiment, a PAR3 ligand domain comprises a polypeptide having, e.g., at most one, two, three or four non-contiguous amino acid substitutions relative to SEQ ID NO: 26. In still other aspects of this embodiment, a PAR3 ligand domain comprises a polypeptide having, e.g., at least one, two, three or four non-contiguous amino acid substitutions relative to SEQ ID NO: 26. In yet other aspects of this embodiment, a PAR3 ligand domain comprises a polypeptide having, e.g., at most one, two, three, four, five, six, seven, eight, nine or ten non-contiguous amino acid additions relative to SEQ ID NO: 26. In yet other aspects of this embodiment, a PAR3 ligand domain comprises a polypeptide having, e.g., at least one, two, three, four, five, six, seven, eight, nine or ten non-contiguous amino acid additions relative to SEQ ID NO: 26. In still other aspects of this embodiment, a PAR3 ligand domain comprises a polypeptide having, e.g., at most one, two or three non-contiguous amino acid deletions relative to SEQ ID NO: 26. In still other aspects of this embodiment, a PAR3 ligand domain comprises a polypeptide having, e.g., at least one, two or three non-contiguous amino acid deletions relative to SEQ ID NO: 26.

In other aspects of this embodiment, a PAR3 ligand domain comprises a polypeptide having, e.g., at most one, two, three or four contiguous amino acid substitutions relative to SEQ ID NO: 26. In still other aspects of this embodiment, a PAR3 ligand domain comprises a polypeptide having, e.g., at least two, three or four contiguous amino acid substitutions relative to SEQ ID NO: 26. In yet other aspects of this embodiment, a PAR3 ligand domain comprises a polypeptide having, e.g., at most two, three, four, five, six, seven, eight, nine or ten contiguous amino acid additions relative to SEQ ID NO: 26. In yet other aspects of this embodiment, a PAR3 ligand domain comprises a polypeptide having, e.g., at least two, three, four, five, six, seven, eight, nine or ten contiguous amino acid additions relative to SEQ ID NO: 26. In still other aspects of this embodiment, a PAR3 ligand domain comprises a polypeptide having, e.g., at most two or three contiguous amino acid deletions relative to SEQ ID NO: 26. In still other aspects of this embodiment, a PAR3 ligand domain comprises a polypeptide having, e.g., at least two or three contiguous amino acid deletions relative to SEQ ID NO: 26.

In another embodiment, a PAR ligand domain comprises a PAR4 ligand domain. In an aspect of this embodiment, a PAR4 ligand domain comprises SEQ ID NO: 28. In another aspect of this embodiment, a PAR4 ligand domain comprises a naturally occurring PAR4 ligand domain variant, such as, e.g., a PAR4 ligand domain isoform or a PAR4 ligand domain subtype. In another aspect of this embodiment, a PAR4 ligand domain comprises a naturally occurring PAR4 ligand domain variant of SEQ ID NO: 28, such as, e.g., a PAR4 ligand domain isoform of SEQ ID NO: 28 or a PAR4 ligand domain subtype of SEQ ID NO: 28. In still another aspect of this embodiment, a PAR4 ligand domain comprises a non-naturally occurring PAR4 ligand domain variant, such as, e.g., a conservative PAR4 ligand domain variant, a non-conservative PAR4 ligand domain variant or a PAR4 ligand domain peptidomimetic, or any combination thereof. In still another aspect of this embodiment, a PAR4 ligand domain comprises a non-naturally occurring PAR4 ligand domain variant of SEQ ID NO: 28, such as, e.g., a conservative PAR4 ligand domain variant of SEQ ID NO: 28, a non-conservative PAR4 ligand domain variant of SEQ ID NO: 28 or a PAR4 ligand domain peptidomimetic of SEQ ID NO: 28, or any combination thereof. In other aspects of this embodiment, a PAR4 ligand domain comprises SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 135 or SEQ ID NO: 160.

In other aspects of this embodiment, a PAR4 ligand domain comprises a polypeptide having, e.g., at least 50% amino acid identity with SEQ ID NO: 28, at least 67% amino acid identity with the SEQ ID NO: 28, or at least 83% amino acid identity with SEQ ID NO: 28. In still other aspects of this embodiment, a PAR4 ligand domain comprises a polypeptide having, e.g., at most 50% amino acid identity with SEQ ID NO: 28, at most 67% amino acid identity with the SEQ ID NO: 28, at most 83% amino acid identity with SEQ ID NO: 28.

In other aspects of this embodiment, a PAR4 ligand domain comprises a polypeptide having, e.g., at most one, two, three or four non-contiguous amino acid substitutions relative to SEQ ID NO: 28. In still other aspects of this embodiment, a PAR4 ligand domain comprises a polypeptide having, e.g., at least one, two, three or four non-contiguous amino acid substitutions relative to SEQ ID NO: 28. In yet other aspects of this embodiment, a PAR4 ligand domain comprises a polypeptide having, e.g., at most one, two, three, four, five, six, seven, eight, nine or ten non-contiguous amino acid additions relative to SEQ ID NO: 28. In yet other aspects of this embodiment, a PAR4 ligand domain comprises a polypeptide having, e.g., at least one, two, three, four, five, six, seven, eight, nine or ten non-contiguous amino acid additions relative to SEQ ID NO: 28. In still other aspects of this embodiment, a PAR4 ligand domain comprises a polypeptide having, e.g., at most one, two or three non-contiguous amino acid deletions relative to SEQ ID NO: 28. In still other aspects of this embodiment, a PAR4 ligand domain comprises a polypeptide having, e.g., at least one, two or three non-contiguous amino acid deletions relative to SEQ ID NO: 28.

In other aspects of this embodiment, a PAR4 ligand domain comprises a polypeptide having, e.g., at most two, three or four contiguous amino acid substitutions relative to SEQ ID NO: 28. In still other aspects of this embodiment, a PAR4 ligand domain comprises a polypeptide having, e.g., at least two, three or four contiguous amino acid substitutions relative to SEQ ID NO: 28. In yet other aspects of this embodiment, a PAR4 ligand domain comprises a polypeptide having, e.g., at most two, three, four, five, six, seven, eight, nine or ten contiguous amino acid additions relative to SEQ ID NO: 28. In yet other aspects of this embodiment, a PAR4 ligand domain comprises a polypeptide having, e.g., at least two, three, four, five, six, seven, eight, nine or ten contiguous amino acid additions relative to SEQ ID NO: 28. In still other aspects of this embodiment, a PAR4 ligand domain comprises a polypeptide having, e.g., at most two or three contiguous amino acid deletions relative to SEQ ID NO: 28. In still other aspects of this embodiment, a PAR4 ligand domain comprises a polypeptide having, e.g., at least two or three contiguous amino acid deletions relative to SEQ ID NO: 28.

When a PAR protease cleaves the extracellular amino-terminus of a PAR, a new amino acid terminus is generated that functions as a tethered ligand. Currently it is believed that the amino terminus location of the tethered ligand is critical for the ligand to effectively bind to the second extracellular loop region of the receptor that comprises the ligand binding domain. It is envisioned that a modified Clostridial toxin of the present specification can comprise a PAR ligand domain in any and all locations with the proviso that formation of the di-chain molecule will result in the free amino terminus of the PAR ligand domain. Non-limiting examples include, locating the PAR ligand domain at the amino terminus of the Clostridial toxin enzymatic domain; locating the PAR ligand domain at the amino terminus of the Clostridial toxin translocation domain; and locating the PAR ligand domain at the amino terminus of the Clostridial toxin binding domain (FIG. 4).

Thus, in an embodiment, a modified Clostridial toxin comprises a PAR ligand domain; a Clostridial toxin enzymatic domain; a Clostridial toxin translocation domain; and a Clostridial toxin binding domain; wherein the PAR ligand domain is located at the amino terminus of the Clostridial toxin enzymatic domain. In an aspect of this embodiment, the PAR ligand domain can be located at the amino terminus of the enzymatic domain when the amino to carboxyl linear organization of the Clostridial toxin single chain molecule is enzymatic domain, translocation domain and binding domain. In another aspect of this embodiment, the PAR ligand domain can be located at the amino terminus of the enzymatic domain when the amino to carboxyl linear organization of the Clostridial toxin single chain molecule is enzymatic domain, binding domain and translocation domain.

In another embodiment, a modified Clostridial toxin comprises a PAR ligand domain; a Clostridial toxin enzymatic domain; a Clostridial toxin translocation domain; and a Clostridial toxin binding domain; wherein the PAR ligand domain is located at the amino terminus of the Clostridial toxin translocation domain. In an aspect of this embodiment, the PAR ligand domain can also be located at the amino terminus of the translocation domain when the amino to carboxyl linear organization of the Clostridial toxin single chain molecule is binding domain, enzymatic domain and translocation domain. In another aspect of this embodiment, the PAR ligand domain can also be located at the amino terminus of the translocation domain when the amino to carboxyl linear organization of the Clostridial toxin single chain molecule is enzymatic domain, translocation domain and binding domain.

In still another embodiment, a modified Clostridial toxin comprises a PAR ligand domain; a Clostridial toxin enzymatic domain; a Clostridial toxin translocation domain; and a Clostridial toxin binding domain; wherein the PAR ligand domain is located at the amino terminus of the Clostridial toxin binding domain. In an aspect of this embodiment, the PAR ligand domain can also be located at the amino terminus of the binding domain when the amino to carboxyl linear organization of the Clostridial toxin single chain molecule is enzymatic domain, binding domain and translocation domain.

TABLE 4

Amino Terminus Region

| Toxin | SEQ ID NO: | PAR Ligand Domain | Light Chain Region |
|---|---|---|---|
| BoNT/A | 1 | M-PAR Ligand Domain | PFVNKQFNYKDPVNGVDIA |
| BoNT/B | 2 | M-PAR Ligand Domain | PVTINNFNYNDPIDNNNII |
| BoNT/C1 | 3 | M-PAR Ligand Domain | PITINNFNYSDPVDNKNIL |
| BoNT/D | 4 | M-PAR Ligand Domain | TWPVKDFNYSDPVNDNDIL |
| BoNT/E | 5 | M-PAR Ligand Domain | PKINSFNYNDPVNDRTILY |
| BoNT/F | 6 | M-PAR Ligand Domain | PVAINSFNYNDPVNDDTIL |
| BoNT/G | 7 | M-PAR Ligand Domain | PVNIKXFNYNDPINNDDII |
| TeNT | 8 | M-PAR Ligand Domain | PITINNFRYSDPVNNDTII |

The amino acid sequence displayed are as follows:
BoNT/A, residues 2-20 of SEQ ID No: 1;
BoNT/B, residues 2-20 of SEQ ID No: 2;
BoNT/C1, residues v of SEQ ID No: 3;
BoNT/D, residues 2-20 of SEQ ID No: 4;
BoNT/E, residues 2-20 of SEQ ID No: 5;
BoNT/F, residues 2-20 of SEQ ID No: 6;
BoNT/G, residues 2-20 of SEQ ID No: 7; and
TeNT, residues 2-20 of SEQ ID No: 8.

In yet another embodiment, the location of the PAR ligand domain is located at the amino terminus of the modified Clostridial toxin. In such a location, the PAR ligand domain can bind to a ligand binding domain of a PAR; proteolytic cleavage is not necessary to unmask the PAR ligand domain. As used herein, the term "unmask" means that the amino terminus of a PAR ligand domain is free to bind to a ligand binding domain of a PAR. It is known in the art that when adding a polypeptide that is operationally-linked to the amino terminus of another polypeptide comprising the start methionine that this methionine residue can be deleted (Table 4). This is due to the fact that the added polypeptide will contain a new start methionine and that the original start methionine may reduce optimal expression of the fusion protein.

In yet another embodiment, the location of the PAR ligand domain is not located at the amino terminus of the modified Clostridial toxin. In such a location, the PAR ligand domain can not bind to a ligand binding domain of a PAR. The PAR ligand domain is considered masked because it is necessary to unmask a PAR ligand domain so that this domain can bind to a ligand binding domain of a PAR. As used herein, the term "masked" means that the amino terminus of a PAR ligand domain is unable to bind to the ligand binding domain of a PAR. To unmask a PAR ligand domain of a modified Clostridial toxin, a protease cleavage site can be placed in front of the PAR ligand domain in such a manner that, upon cleavage with an appropriate protease, the masked PAR ligand domain becomes unmasked and is now capable of binding a PAR ligand binding domain. It is envisioned that any and all proteases that can cleave a modified Clostridial toxin disclosed in the present specification so as to unmask a PAR ligand domain can be used, including without limitation, a Clostridial toxin protease cleavage site found in the di-chain loop, a PAR protease cleavage site used to unmask the tethered ligand in vivo, and an exogenous protease cleavage site.

As mentioned above, a Clostridial toxin is converted from a single polypeptide form into a di-chain molecule by proteolytic cleavage. While the identity of the protease is currently unknown, the di-chain loop protease cleavage site for many Clostridial toxins has been determined. In BoNTs, cleavage at K448-A449 converts the single polypeptide form of BoNT/A into the di-chain form; cleavage at K441-A442 converts the single polypeptide form of BoNT/B into the di-chain form; cleavage at K449-T450 converts the single polypeptide form of BoNT/C1 into the di-chain form; cleavage at R445-D446 converts the single polypeptide form of BoNT/D into the di-chain form; cleavage at R422-K423 converts the single polypeptide form of BoNT/E into the di-chain form; cleavage at K439-A440 converts the single polypeptide form of BoNT/F into the di-chain form; and cleavage at K446-S447 converts the single polypeptide form of BoNT/G into the di-chain form. Proteolytic cleavage of the single polypeptide form of TeNT at A457-S458 results in the di-chain form. Such a di-chain loop protease cleavage site is operably-linked in-frame to a modified Clostridial toxin as a fusion protein. However, it should also be noted that additional cleavage sites within the di-chain look also appear to be cleaved resulting in the generation of a small peptide fragment being lost. As a non-limiting example, BoNT/A single-chain polypeptide cleave ultimately results in the loss of a ten amino acid fragment within the di-chain loop.

Thus, in an embodiment, proteolytic cleavage of an endogenous Clostridial toxin di-chain loop protease cleavage site is used to unmask a PAR ligand domain. In aspects of this embodiment, a PAR ligand domain is unmasked by proteolytic cleavage of, e.g., a BoNT/A di-chain loop protease cleavage site, a BoNT/B di-chain loop protease cleavage site, a BoNT/C1 di-chain loop protease cleavage site, a BoNT/D di-chain loop protease cleavage site, a BoNT/E di-chain loop protease cleavage site, a BoNT/F di-chain loop protease cleavage site, a BoNT/G di-chain loop protease cleavage site or a TeNT di-chain loop protease cleavage site.

A wide variety of endogenous PAR proteases are known to cleave a PAR in such a manner as to unmask the tethered ligand and, therefore, can also be used to unmask the PAR ligand domain. The coagulant protease Thrombin is the physiological activator of PAR1, PAR3 and PAR4. Other PAR proteases, however, can also activate PAR receptors by proteolytic cleavage including, without limitation, APC, Cathepsin G, Factor VIIa, Factor Xa, Granzyme A, Gingipains-R, Plasmin and Trypsins (Table 2). PAR2 can also be activated by multiple proteases including, without limitation, Acrosien, Der P1, Der P3, Der P9, Factor VIIa, Factor Xa, Gingipains-R, MT-SP1, Proteinase-3, Trypsins and Tryptases (Table 2). It is envisioned that both endogenous protease cleavage sites found associated with a particular PAR ligand domain, as well as exogenous protease cleavage sites from other PAR ligand domains can be used to cleave a modified Clostridial toxin disclosed in the present specification in order to unmask the PAR ligand binding domain. Such a PAR protease cleavage site is operably-linked in-frame to a modified Clostridial toxin as a fusion protein. As a non-limiting example, a PAR1 ligand domain can be unmasked using the protease cleavage site associated with the in vivo PAR1 molecule, or a PAR1 ligand domain can be unmasked using the protease cleavage site associated with PAR2, PAR3 or PAR4 (Table 2). As another non-limiting example, a PAR2 ligand domain can be unmasked using the protease cleavage site associated with the in vivo PAR2 molecule, or a PAR2 ligand domain can be unmasked using the protease cleavage site associated PAR1, PAR3 or PAR4 (Table 2). As still another non-limiting example, a PAR3 ligand domain can be unmasked using the protease cleavage site associated with the in vivo PAR3 molecule, or a PAR3 ligand domain can be unmasked using the protease cleavage site associated with PAR1, PAR2 or PAR4 (Table 2). As yet another non-limiting example, a PAR4 ligand domain can be unmasked using the protease cleavage site associated with the in vivo PAR4 molecule, or a PAR4 ligand domain can be unmasked using the protease cleavage site associated with PAR1, PAR2 or PAR3 (Table 2).

Thus, in an embodiment, proteolytic cleavage of an endogenous PAR1 protease cleavage site is used to unmask a PAR ligand domain. In aspects of this embodiment, a PAR ligand domain is unmasked by proteolytic cleavage of, e.g., an APC protease cleavage site, a Factor Xa protease cleavage site, a Granzyme A protease cleavage site, a Gingipains-R protease cleavage site, a Thrombin protease cleavage site or a Trypsin protease cleavage site. In other aspects of this embodiment, a PAR1 protease cleavage site is cleaved by, e.g., an APC protease, a Factor Xa protease, a Granzyme A protease, a Gingipains-R protease, a Thrombin protease or a Trypsin protease.

In another embodiment, proteolytic cleavage of an endogenous PAR2 protease cleavage site is used to unmask a PAR ligand domain. In aspects of this embodiment, a PAR ligand domain is unmasked by proteolytic cleavage of, e.g., an Acrosien protease cleavage site, a Der P1 protease cleavage site, a Der P3 protease cleavage site, a Der P9 protease cleavage site, a Factor VIIa protease cleavage site, a Factor Xa protease cleavage site, a Gingipains-R protease cleavage site, a MT-SP1 protease cleavage site, a Proteinase-3 protease cleavage site, a Trypsin protease cleavage site or a Tryptase protease cleavage site. In other aspects of this embodiment, a PAR2 protease cleavage site is cleaved by, e.g., an Acrosien protease, a Der P1 protease, a Der P3 protease, a Der P9 protease, a Factor VIIa protease, a Factor Xa protease, a Gingipains-R protease, a MT-SP1 protease, a Proteinase-3 protease, a Trypsin protease or a Tryptase protease.

In another embodiment, proteolytic cleavage of an endogenous PAR3 protease cleavage site is used to unmask a PAR ligand domain. In an aspect of this embodiment, a PAR ligand domain is unmasked by proteolytic cleavage of, e.g., a Thrombin protease cleavage site. In another aspect of this embodiment, a PAR3 protease cleavage site is cleaved by, e.g., a Thrombin protease.

In another embodiment, proteolytic cleavage of an endogenous PAR4 protease cleavage site is used to unmask a PAR ligand domain. In aspects of this embodiment, a PAR ligand domain is unmasked by proteolytic cleavage of, e.g., a Cathepsin G protease cleavage site, a Factor VIIa protease cleavage site, a Factor Xa protease cleavage site, a Gingipains-R protease cleavage site, a Plasmin protease cleavage site, a Thrombin protease cleavage site or a Trypsin protease cleavage site. In other aspects of this embodiment, a PAR4 protease cleavage site is cleaved by, e.g., a Cathepsin G protease, a Factor VIIa protease, a Factor Xa protease, a Gingipains-R protease, a Plasmin protease, a Thrombin protease or a Trypsin protease.

It is also envisioned that an exogenous protease cleavage site can be used to unmask a PAR ligand domain. Such an exogenous protease cleavage site is operably-linked in-frame to a modified Clostridial toxin as a fusion protein. Non-limiting examples of protease cleavage sites include, e.g., an enterokinase cleavage site (Table 5); a Thrombin cleavage site (Table 5); a Factor Xa cleavage site (Table 5); a human rhinovirus 3C protease cleavage site (Table 4); a tobacco etch virus (TEV) protease cleavage site (Table 5); a dipeptidyl aminopeptidase cleavage site and a small ubiquitin-like modifier (SUMO)/ubiquitin-like protein-1 (ULP-1) protease cleavage site, such as, e.g., MADSEVNQEAKPEVKPEVK-PETHINLKVSDGSSEIFFKIKKTTPLR-RLMEAFAKRQGKEMDSLRFLYD-GIRIQADQTPEDLDMEDNDI IEAHREQIGG (SEQ ID. NO: 67). As a non-limiting example, a PAR1 ligand domain can be unmasked using a bovine enterokinase protease cleavage site, a Tobacco Etch Virus protease cleavage site, a Human Rhinovirus 3C protease cleavage site, a SUMO/ULP-1 protease cleavage site, a Thrombin protease cleavage site or a Factor Xa protease cleavage site (Table 5). As another non-limiting example, a PAR2 ligand domain can be unmasked using a bovine enterokinase protease cleavage site, a Tobacco Etch Virus protease cleavage site, a Human Rhinovirus 3C protease cleavage site, a SUMO/ULP-1 protease cleavage site, a Thrombin protease cleavage site or a Factor Xa protease cleavage site (Table 5). As still another non-limiting example, a PAR3 ligand domain can be unmasked using a bovine enterokinase protease cleavage site, a Tobacco Etch Virus protease cleavage site, a Human Rhinovirus 3C protease cleavage site, a SUMO/ULP-1 protease cleavage site, a Thrombin protease cleavage site or a Factor Xa protease cleavage site (Table 5). As yet another non-limiting example, a PAR4 ligand domain can be unmasked using a bovine enterokinase protease cleavage site, a Tobacco Etch Virus protease cleavage site, a Human Rhinovirus 3C protease cleavage site, a SUMO/ULP-1 protease cleavage site, a Thrombin protease cleavage site or a Factor Xa protease cleavage site (Table 5).

Thus, in an embodiment, proteolytic cleavage of an exogenous protease cleavage site is used to unmask a PAR ligand domain. In aspects of this embodiment, a PAR ligand domain is unmasked by proteolytic cleavage of, e.g., a bovine enterokinase protease cleavage site, a Tobacco Etch Virus protease cleavage site, a Human Rhinovirus 3C protease cleavage site, a SUMO/ULP-1 protease cleavage site, a Thrombin protease cleavage site or a Factor Xa protease cleavage site. In other aspects of this embodiment, a PAR protease cleavage site is cleaved by, e.g., a bovine enterokinase protease, a Tobacco Etch Virus protease, a Human Rhinovirus 3C protease, a SUMO/ULP-1 protease, a Thrombin protease or a Factor Xa protease, thereby unmasking a PAR ligand domain.

In another embodiment, proteolytic cleavage of an exogenous protease cleavage site is used to unmask a PAR1 ligand domain. In aspects of this embodiment, a PAR1 ligand domain is unmasked by proteolytic cleavage of, e.g., a bovine enterokinase protease cleavage site, a Tobacco Etch Virus protease cleavage site, a Human Rhinovirus 3C protease cleavage site, a SUMO/ULP-1 protease cleavage site, a Thrombin protease cleavage site or a Factor Xa protease cleavage site. In other aspects of this embodiment, a PAR1 protease cleavage site is cleaved by, e.g., a bovine enterokinase protease, a Tobacco Etch Virus protease, a Human Rhinovirus 3C protease, a SUMO/ULP-1 protease, a Thrombin protease or a Factor Xa protease, thereby unmasking a PAR1 ligand domain.

In another embodiment, proteolytic cleavage of an exogenous protease cleavage site is used to unmask a PAR2 ligand domain. In aspects of this embodiment, a PAR2 ligand domain is unmasked by proteolytic cleavage of, e.g., a bovine enterokinase protease cleavage site, a Tobacco Etch Virus protease cleavage site, a Human Rhinovirus 3C protease cleavage site, a SUMO/ULP-1 protease cleavage site, a Thrombin protease cleavage site or a Factor Xa protease

TABLE 5

Exogenous Protease Cleavage Sites

| Protease Cleavage Site | Consensus Sequence | Non-limiting Examples | SEQ ID NO: |
|---|---|---|---|
| Bovine enterokinase | DDDDK* | DDDDK* | 50 |
| Tobacco Etch Virus (TEV) | E $P^5$ $P^4YP^2Q*(G/S)$, where $P^2$, $P^4$ and $P^5$ can be any amino acid | ENLYFQ*G ENLYFQ*S ENIYTQ*G ENIYTQ*S ENIYLQ*G ENIYLQ*S ENVYFQ*G ENVYSQ*S ENVYSQ*G ENVYSQ*S | 51 52 53 54 55 56 57 58 59 60 |
| Human Rhinovirus 3C | $P^5P^4$LFQ*GP where $P^4$ is G, A, V, L, I, M, S or T and $P^5$ can any amino acid, with D or E preferred. | EALFQ*GP EVLFQ*GP ELLFQ*GP DALFQ*GP DVLFQ*GP DLLFQ*GP | 61 62 63 64 65 66 |
| SUMO/ULP-1 | Tertiary structure | polypeptide-G* | 67 |
| Thrombin | $P^3P^2(R/K)*P^{1'}$, where $P^3$ is any amino acid and $P^2$ or $P^{1'}$ is G with the other position being any amino acid | GVR*G SAR*G SLR*G DGR*I QGK*I | 68 69 70 71 72 |
| Thrombin | $P^4P^3P(R/K)*P^{1'}P^{2'}$ where $P^{1'}$ and $P^{2'}$ can be any amino acid except for acidic amino acids like D or E; and $P^3$ and $P^4$ are hydrophobic amino acids like F, L, I, Y, W, V, M, P, C or A | LVPR*GS LVPK*GS FIPR*TF VLPR*SF IVPR*SF IVPR*GY VVPR*GV VLPR*LI VMPR*SL MFPR*SL | 73 74 75 76 77 78 79 80 81 82 |
| Coagulation Factor Xa | I(E/D)GR* | IDGR* IEGR* | 83 84 |

An asterisks (*) indicates the peptide bond that is cleaved by the indicated protease.

cleavage site. In other aspects of this embodiment, a PAR2 protease cleavage site is cleaved by, e.g., a bovine enterokinase protease, a Tobacco Etch Virus protease, a Human Rhinovirus 3C protease, a SUMO/ULP-1 protease, a Thrombin protease or a Factor Xa protease, thereby unmasking a PAR2 ligand domain.

In still another embodiment, proteolytic cleavage of an exogenous protease cleavage site is used to unmask a PAR3 ligand domain. In aspects of this embodiment, a PAR3 ligand domain is unmasked by proteolytic cleavage of, e.g., a bovine enterokinase protease cleavage site, a Tobacco Etch Virus protease cleavage site, a Human Rhinovirus 3C protease cleavage site, a SUMO/ULP-1 protease cleavage site, a Thrombin protease cleavage site or a Factor Xa protease cleavage site. In other aspects of this embodiment, a PAR3 protease cleavage site is cleaved by, e.g., a bovine enterokinase protease, a Tobacco Etch Virus protease, a Human Rhinovirus 3C protease, a SUMO/ULP-1 protease, a Thrombin protease or a Factor Xa protease, thereby unmasking a PAR3 ligand domain.

In another embodiment, proteolytic cleavage of an exogenous protease cleavage site is used to unmask a PAR4 ligand domain. In aspects of this embodiment, a PAR4 ligand domain is unmasked by proteolytic cleavage of, e.g., a bovine enterokinase protease cleavage site, a Tobacco Etch Virus protease cleavage site, a Human Rhinovirus 3C protease cleavage site, a SUMO/ULP-1 protease cleavage site, a Thrombin protease cleavage site or a Factor Xa protease cleavage site. In other aspects of this embodiment, a PAR4 protease cleavage site is cleaved by, e.g., a bovine enterokinase protease, a Tobacco Etch Virus protease, a Human Rhinovirus 3C protease, a SUMO/ULP-1 protease, a Thrombin protease or a Factor Xa protease, thereby unmasking a PAR4 ligand domain.

It is understood that a modified Clostridial toxin disclosed in the present specification can optionally include one or more additional components. As a non-limiting example of an optional component, a modified Clostridial toxin can further comprise a flexible region comprising a flexible spacer. Non-limiting examples of a flexible spacer include, e.g., a G-spacer GGGGS (SEQ ID NO: 48) or an A-spacer EAAAK (SEQ ID NO: 49). A flexible region comprising flexible spacers can be used to adjust the length of a polypeptide region in order to optimize a characteristic, attribute or property of a polypeptide. Such a flexible region is operably-linked in-frame to the modified Clostridial toxin as a fusion protein. As a non-limiting example, a polypeptide region comprising one or more flexible spacers in tandem can be use to better expose a protease cleavage site thereby facilitating cleavage of that site by a protease. As another non-limiting example, a polypeptide region comprising one or more flexible spacers in tandem can be use to better present a ligand domain, thereby facilitating the binding of that ligand domain to its binding domain on a receptor.

Thus, in an embodiment, a modified Clostridial toxin disclosed in the present specification can further comprise a flexible region comprising a flexible spacer. In another embodiment, a modified Clostridial toxin disclosed in the present specification can further comprise flexible region comprising a plurality of flexible spacers in tandem. In aspects of this embodiment, a flexible region can comprise in tandem, e.g., at least 1 G-spacer, at least 2 G-spacers, at least 3 G-spacers, at least 4 G-spacers or at least 5 G-spacers. In other aspects of this embodiment, a flexible region can comprise in tandem, e.g., at most 1 G-spacer, at most 2 G-spacers, at most 3 G-spacers, at most 4 G-spacers or at most 5 G-spacers. In still other aspects of this embodiment, a flexible region can comprise in tandem, e.g., at least 1 A-spacer, at least 2 A-spacers, at least 3 A-spacers, at least 4 A-spacers or at least 5 A-spacers. In still other aspects of this embodiment, a flexible region can comprise in tandem, e.g., at most 1 A-spacer, at most 2 A-spacers, at most 3 A-spacers, at most 4 A-spacers or at most 5 A-spacers. In another aspect of this embodiment, a modified Clostridial toxin can comprise a flexible region comprising one or more copies of the same flexible spacers, one or more copies of different flexible-spacer regions, or any combination thereof.

As another non-limiting example of an optional component, a modified Clostridial toxin can further comprise an epitope-binding region. An epitope-binding region can be used in a wide variety of procedures involving, e.g., protein purification and protein visualization. Such an epitope-binding region is operably-linked in-frame to a modified Clostridial toxin as a fusion protein. Non-limiting examples of an epitope-binding region include, e.g., FLAG, Express™, human Influenza virus hemagluttinin (HA), human $p62^{c-Myc}$ protein (c-MYC), Vesicular Stomatitis Virus Glycoprotein (VSV-G), glycoprotein-D precursor of Herpes simplex virus (HSV), V5, and AU1; affinity-binding, such as. e.g., polyhistidine (HIS), streptavidin binding peptide (strep), and biotin or a biotinylation sequence; peptide-binding regions, such as. e.g., the glutathione binding domain of glutathione-S-transferase, the calmodulin binding domain of the calmodulin binding protein, and the maltose binding domain of the maltose binding protein. Non-limiting examples of specific protocols for selecting, making and using an appropriate binding peptide are described in, e.g., Epitope Tagging, pp. 17.90-17.93 (Sambrook and Russell, eds., Molecular Cloning A Laboratory Manual, Vol. 3, $3^{rd}$ ed. 2001); Antibodies: A Laboratory Manual (Edward Harlow & David Lane, eds., Cold Spring Harbor Laboratory Press, $2^{nd}$ ed. 1998); and Using Antibodies: A Laboratory Manual: Portable Protocol No. I (Edward Harlow & David Lane, Cold Spring Harbor Laboratory Press, 1998). In addition, non-limiting examples of binding peptides as well as well-characterized reagents, conditions and protocols are readily available from commercial vendors that include, without limitation, BD Biosciences-Clontech, Palo Alto, Calif.; BD Biosciences Pharmingen, San Diego, Calif.; Invitrogen, Inc, Carlsbad, Calif.; QIAGEN, Inc., Valencia, Calif.; and Stratagene, La Jolla, Calif. These protocols are routine procedures well within the scope of one skilled in the art and from the teaching herein.

Thus, in an embodiment, a modified Clostridial toxin disclosed in the present specification can further comprise an epitope-binding region. In another embodiment, a modified Clostridial toxin disclosed in the present specification can further comprises a plurality of epitope-binding regions. In aspects of this embodiment, a modified Clostridial toxin can comprise, e.g., at least 1 epitope-binding region, at least 2 epitope-binding regions, at least 3 epitope-binding regions, at least 4 epitope-binding regions or at least 5 epitope-binding regions. In other aspects of this embodiment, a modified Clostridial toxin can comprise, e.g., at most 1 epitope-binding region, at most 2 epitope-binding regions, at most 3 epitope-binding regions, at most 4 epitope-binding regions or at most 5 epitope-binding regions. In another aspect of this embodiment, a modified Clostridial toxin can comprise one or more copies of the same epitope-binding region, one or more copies of different epitope-binding regions, or any combination thereof. The location of an epitope-binding region can be in various positions, including, without limitation, at the amino terminus of a modified Clostridial toxin, within a modified Clostridial toxin, or at the carboxyl terminus of a modified Clostridial toxin.

As still another non-limiting example of an optional component, a modified Clostridial toxin can further comprise an exogenous protease cleavage site. An exogenous protease cleavage site can be used in a wide variety of procedures involving, e.g., removal of an epitope-binding region by proteolytic cleavage, conversion of a Clostridial toxin single chain polypeptide into the di-chain form or, as mentioned above, unmasking of a PAR ligand domain. Such an exogenous protease cleavage site is operably-linked in-frame to a modified Clostridial toxin as a fusion protein. Non-limiting examples of protease cleavage sites include, e.g., an enterokinase cleavage site (Table 5); a Thrombin cleavage site (Table 5); a Factor Xa cleavage site (Table 5); a human rhinovirus 3C protease cleavage site (Table 4); a tobacco etch virus (TEV) protease cleavage site (Table 5); a dipeptidyl aminopeptidase cleavage site and a small ubiquitin-like modifier (SUMO)/ubiquitin-like protein-1(ULP-1) protease cleavage site, such as, e.g., MADSEVNQEAKPEVKPEVKPETHIN-LKVSDGSSEIFFKIKKTTPLRRLMEAF-AKRQGKEMDSLRFLY DGIRIQADQTPEDLDMEDN-DIIEAHREQIGG (SEQ ID. NO: 67).

Thus, in an embodiment, a modified Clostridial toxin disclosed in the present specification can further comprise an exogenous protease cleavage site. In another embodiment, a modified Clostridial toxin disclosed in the present specification can further comprises a plurality of exogenous protease cleavage sites. In aspects of this embodiment, a modified Clostridial toxin can comprise, e.g., at least 1 exogenous protease cleavage site, at least 2 exogenous protease cleavage sites, at least 3 exogenous protease cleavage sites, at least 4 exogenous protease cleavage sites or at least 5 exogenous protease cleavage sites. In other aspects of this embodiment, a modified Clostridial toxin can comprise, e.g., at most 1 exogenous protease cleavage site, at most 2 exogenous protease cleavage sites, at most 3 exogenous protease cleavage sites, at most 4 exogenous protease cleavage sites or at most 5 exogenous protease cleavage sites. In another aspect of this embodiment, a modified Clostridial toxin can comprise one or more copies of the same exogenous protease cleavage site, one or more copies of different exogenous protease cleavage sites, or any combination thereof.

The location of an exogenous protease cleavage site may be in a variety of positions, including, without limitation, between an epitope-binding region and a modified Clostridial toxin in order to facilitate removal of the epitope-binding region by proteolytic cleavage or within the di-chain loop of the modified Clostridial toxin in order to facilitate the conversion of the single-chain polypeptide form of the toxin into the di-chain form.

It is envisioned that an exogenous protease cleavage site can be used to remove an epitope-binding region. As mentioned above, epitope binding regions can be used in protein purification procedures and it is often desirable to remove such epitope binding regions after the protein is purified. A common way of doing so is to have a protease cleavage site in between the protein of interest and the epitope binding region, whereby proteolytic cleavage of the protease cleavage site separates the protein of interest from the epitope binding region. Non-limiting examples of protease cleavage sites used for the removal of epitope-binding regions as well as well-characterized proteases, reagents, conditions and protocols are readily available from commercial vendors that include, without limitation, BD Biosciences-Clontech, Palo Alto, Calif.; BD Biosciences Pharmingen, San Diego, Calif.; Invitrogen, Inc, Carlsbad, Calif.; QIAGEN, Inc., Valencia, Calif.; and Stratagene, La Jolla, Calif. The selection, making and use of an appropriate protease cleavage site are routine procedures within the scope of one skilled in the art and from the teaching herein.

Thus, in an embodiment, an exogenous protease cleavage site is located between an epitope-binding peptide and a modified Clostridial toxin. In other aspects of this embodiment, a bovine enterokinase cleavage site is located between an epitope-binding region and a modified Clostridial toxin, a Tobacco Etch Virus protease cleavage site is located between an epitope-binding region and a modified Clostridial toxin, a Human Rhinovirus 3C protease cleavage site is located between an epitope-binding region and a modified Clostridial toxin, a SUMO/ULP-1 protease cleavage site is located between an epitope-binding region and a modified Clostridial toxin, a Thrombin protease cleavage site is located between an epitope-binding region and a modified Clostridial toxin, or a Coagulation Factor Xa protease cleavage site is located between an epitope-binding region and a modified Clostridial toxin. In other aspects of the embodiment, the bovine enterokinase protease cleavage site located between an epitope-binding region and a modified Clostridial toxin comprises SEQ ID NO: 50. In other aspects of the embodiment, the Tobacco Etch Virus protease cleavage site located between an epitope-binding region and a modified Clostridial toxin comprises SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59 or SEQ ID NO: 60. In still other aspects of the embodiment, the Human Rhinovirus 3C protease cleavage site located between an epitope-binding region and a modified Clostridial toxin comprises SEQ ID NO: 61, SEQ ID NO: 62, SEQ ID NO: 63, SEQ ID NO: 64, SEQ ID NO: 65 or SEQ ID NO: 66. In yet other aspects of the embodiment, the SUMO/ULP-1 protease cleavage site located between an epitope-binding region and a modified Clostridial toxin comprises SEQ ID NO: 67. In further other aspects of the embodiment, the Thrombin protease cleavage site located between an epitope-binding region and a modified Clostridial toxin comprises SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81 or SEQ ID NO: 82. In other aspects of the embodiment, the Coagulation Factor Xa protease cleavage site located between an epitope-binding region and a modified Clostridial toxin comprises SEQ ID NO: 83 or SEQ ID NO: 84.

TABLE 6

Di-chain Loop Region

| Toxin | SEQ ID NO: | Light Chain Region | Di-chain Loop Protease Cleavage Site Region | Heavy Chain Region |
|---|---|---|---|---|
| BoNT/A | 1 | NMNFTKLKNFTGLFEFYKLL | CVRGIITSKTKSLDKGYNK*----ALNDLC | IKVNINWDL |
| BoNT/B | 2 | KQAYEEISKEHLAVYKIQM | CKSVK*------------------APGIC | IDVDNEDL |
| BoNT/C1 | 3 | PALRKVNPENMLYLFTKF | CHKAIDGRSLYNK*------------TLDC | RELLVKNTDL |

TABLE 6-continued

Di-chain Loop Region

| Toxin | SEQ ID NO: | Light Chain Region | Di-chain Loop Protease Cleavage Site Region | Heavy Chain Region |
|---|---|---|---|---|
| BoNT/D | 4 | PALQKLSSESVVDLFTKV | CLRLTKNSR*---------------DDSTC | IKVKNNRL |
| BoNT/E | 5 | IITPITGRGLVKKIIRF | CKNIVSVKGIR*--------------KSIC | IEINNGEL |
| BoNT/F | 6 | IIDSIPDKGLVEKIVKF | CKSVIPRKGTK*------------APPRLC | IRVNNSEL |
| BoNT/G | 7 | KEAYEEISLEHLVIYRIAM | CKPVMYKNTGK*--------------SEQC | IIVNNEDL |
| TeNT | 8 | TNAFRNVDGSGLVSKLIGL | CKKIIPPTNIRENLYNRTA*SLTDLGGLEC | IKIKNEDL |

The amino acid sequence displayed are as follows:
BoNT/A, residues 410-462 of SEQ ID No: 1;
BoNT/B, residues 418-454 of SEQ ID No: 2;
BoNT/C1, residues 419-463 of SEQ ID No: 3;
BoNT/D, residues 419-458 of SEQ ID No: 4;
BoNT/E, residues 393-434 of SEQ ID No: 5;
BoNT/F, residues 410-453 of SEQ ID No: 6;
BoNT/G, residues 419-458 of SEQ ID No: 7; and
TeNT, residues 422-475 of SEQ ID No: 8.
An asterisks (*) indicates the peptide bond that is cleaved by a Clostridial toxin protease.

It is envisioned that an exogenous protease cleavage site can be used to convert the single-chain polypeptide form of a modified Clostridial toxin disclosed in the present specification into the di-chain form. As mentioned above, Clostridial toxins are translated as a single-chain polypeptide of approximately 150 kDa that is subsequently cleaved by proteolytic scission within a disulfide loop by a naturally-occurring protease. This posttranslational processing yields a di-chain molecule comprising an approximately 50 kDa light chain (LC) and an approximately 100 kDa heavy chain (HC) held together by a single disulphide bond and noncovalent interactions. While the naturally-occurring protease is currently not known, cleavage occurs within the di-chain loop region between the two cysteine residues that form the disulfide bridge (Table 6). Replacement of the naturally-occurring protease cleavage site with an exogenous protease cleavage site will enable cleavage of a modified Clostridial toxin disclosed in the present specification when expressed in an organism that does not produce the endogenous Clostridial protease used to cleave the di-chain loop region of a toxin.

Thus in an embodiment, an exogenous protease cleavage site is located within the di-chain loop of a modified Clostridial toxin. In aspects of this embodiment, a bovine enterokinase cleavage site is located within the di-chain loop of a modified Clostridial toxin, a Tobacco Etch Virus protease cleavage site is located within the di-chain loop of a modified Clostridial toxin, a Human Rhinovirus 3C protease cleavage site is located within the di-chain loop of a modified Clostridial toxin, a SUMO/ULP-1 protease cleavage site is located within the di-chain loop of a modified Clostridial toxin, a Thrombin protease cleavage site is located within the di-chain loop of a modified Clostridial toxin, or a Coagulation Factor Xa protease cleavage site is located within the di-chain loop of a modified Clostridial toxin. In other aspects of the embodiment, the bovine enterokinase protease cleavage site located within the di-chain loop of a modified Clostridial toxin comprises SEQ ID NO: 50. In other aspects of the embodiment, the Tobacco Etch Virus protease cleavage site located within the di-chain loop of a modified Clostridial toxin comprises SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59 or SEQ ID NO: 60. In still other aspects of the embodiment, the Human Rhinovirus 3C protease cleavage site located within the di-chain loop of a modified Clostridial toxin comprises SEQ ID NO: 61, SEQ ID NO: 62, SEQ ID NO: 63, SEQ ID NO: 64, SEQ ID NO: 65 or SEQ ID NO: 66. In yet other aspects of the embodiment, the SUMO/ULP-1 protease cleavage site located within the di-chain loop of a modified Clostridial toxin comprises SEQ ID NO: 67. In further other aspects of the embodiment, the Thrombin protease cleavage site located within the di-chain loop of a modified Clostridial toxin comprises SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81 or SEQ ID NO: 82. In other aspects of the embodiment, the Coagulation Factor Xa protease cleavage site located within the di-chain loop of a modified Clostridial toxin comprises SEQ ID NO: 83 or SEQ ID NO: 84.

Aspects of the present invention provide, in part modified Clostridial toxins. Non-limiting examples of Clostridial toxin modifications disclosed in the present specification include, e.g., addition of a PAR ligand domain, addition of a protease cleavage site, rearrangement of the enzymatic, translocation and binding domains, addition of a spacer region and addition of an epitope-binding region. It is understood that all such modifications do not substantially affect the ability of a Clostridial toxin to intoxicate a cell. As used herein, the term "do not substantially affect" means a Clostridial toxin can still execute the overall cellular mechanism whereby a Clostridial toxin enters a neuron and inhibits neurotransmitter release and encompasses the binding of a Clostridial toxin to a low or high affinity receptor complex, the internalization of the toxin/receptor complex, the translocation of the Clostridial toxin light chain into the cytoplasm and the enzymatic modification of a Clostridial toxin substrate. In aspects of this embodiment, the modified Clostridial toxin is, e.g., at least 10% as toxic as a naturally-occurring Clostridial toxin, at least 20% as toxic as a naturally-occurring Clostridial toxin, at least 30% as toxic as a naturally-occurring Clostridial toxin, at least 40% as toxic as a naturally-occurring Clostridial toxin, at least 50% as toxic as a naturally-occurring Clostridial toxin, at least 60% as toxic as a naturally-occurring Clostridial toxin, at least 70% as toxic as a naturally-occurring Clostridial toxin, at least 80% as toxic as a naturally-occurring Clostridial toxin, at least 90% as toxic as a naturally-occurring Clostridial toxin or at least 95% as toxic as a naturally-occurring Clostridial toxin. In aspects of this embodiment, the modified Clostridial toxin is, e.g., at most 10% as toxic as a naturally-occurring Clostridial toxin, at most 20% as toxic as a naturally-occurring Clostridial toxin, at most 30% as toxic as a naturally-occurring Clostridial toxin, at most 40% as toxic as a naturally-occurring Clostridial toxin, at most 50% as toxic as a naturally-occurring Clostridial toxin, at most 60% as toxic as a naturally-occurring Clostridial toxin, at most 70% as toxic as a naturally-occurring Clostridial toxin, at most 80% as toxic as a naturally-occurring Clostridial toxin, at most 90% as toxic as a naturally-occurring Clostridial toxin or at most 95% as toxic as a naturally-occurring Clostridial toxin.

Aspects of the present invention provide, in part polynucleotide molecules. As used herein, the term "polynucleotide molecule" is synonymous with "nucleic acid molecule" and means a polymeric form of nucleotides, such as, e.g., ribonucleotides and deoxyribonucleotides, of any length. It is envisioned that any and all polynucleotide molecules that can encode a modified Clostridial toxin disclosed in the present specification can be useful, including, without limitation naturally-occurring and non-naturally-occurring DNA molecules and naturally-occurring and non-naturally-occurring RNA molecules. Non-limiting examples of naturally-occurring and non-naturally-occurring DNA molecules include single-stranded DNA molecules, double-stranded DNA molecules, genomic DNA molecules, cDNA molecules, vector constructs, such as, e.g., plasmid constructs, phagmid constructs, bacteriophage constructs, retroviral constructs and artificial chromosome constructs. Non-limiting examples of naturally-occurring and non-naturally-occurring RNA molecules include single-stranded RNA, double stranded RNA and mRNA.

Thus, in an embodiment, a polynucleotide molecule encodes a Clostridial toxin comprises a Clostridial toxin enzymatic domain, a Clostridial toxin translocation domain and a Clostridial toxin binding domain. In an aspect of this embodiment, a polynucleotide molecule encodes a Clostridial toxin comprises a naturally occurring Clostridial toxin variant, such as, e.g., a Clostridial toxin isoform or a Clostridial toxin subtype. In another aspect of this embodiment, a polynucleotide molecule encodes a Clostridial toxin comprises a non-naturally occurring Clostridial toxin variant, such as, e.g., a conservative Clostridial toxin variant, a non-conservative Clostridial toxin variant or an active Clostridial toxin fragment, or any combination thereof. In another aspect of this embodiment, a polynucleotide molecule encodes a Clostridial toxin comprises a Clostridial toxin enzymatic domain or an active fragment thereof, a Clostridial toxin translocation domain or an active fragment thereof, a Clostridial toxin binding domain or an active fragment thereof, or any combination thereof. In other aspects of this embodiment, a Clostridial toxins comprises a BoNT/A, a BoNT/B, a BoNT/C1, a BoNT/D, a BoNT/E, a BoNT/F, a BoNT/G or a TeNT.

In another embodiment, a polynucleotide molecule encodes a Clostridial toxin comprising a BoNT/A. In an aspect of this embodiment, a polynucleotide molecule encodes a BoNT/A comprising a BoNT/A enzymatic domain, a BoNT/A translocation domain and a BoNT/A binding domain. In another aspect of this embodiment, a polynucleotide molecule encodes a BoNT/A comprising SEQ ID NO: 1. In another aspect of this embodiment, a polynucleotide molecule encodes a BoNT/A comprising a naturally occurring BoNT/A variant, such as, e.g., a BoNT/A isoform or a BoNT/A subtype. In another aspect of this embodiment, a polynucleotide molecule encodes a BoNT/A comprising a naturally occurring BoNT/A variant of SEQ ID NO: 1, such as, e.g., a BoNT/A isoform of SEQ ID NO: 1 or a BoNT/A subtype of SEQ ID NO: 1. In still another aspect of this embodiment, a polynucleotide molecule encodes a BoNT/A comprising a non-naturally occurring BoNT/A variant, such as, e.g., a conservative BoNT/A variant, a non-conservative BoNT/A variant or an active BoNT/A fragment, or any combination thereof. In still another aspect of this embodiment, a polynucleotide molecule encodes a BoNT/A comprising a non-naturally occurring BoNT/A variant of SEQ ID NO: 1, such as, e.g., a conservative BoNT/A variant of SEQ ID NO: 1, a non-conservative BoNT/A variant of SEQ ID NO: 1 or an active BoNT/A fragment of SEQ ID NO: 1, or any combination thereof. In yet another aspect of this embodiment, a polynucleotide molecule encodes a BoNT/A comprising a BoNT/A enzymatic domain or an active fragment thereof, a BoNT/A translocation domain or an active fragment thereof, a BoNT/A binding domain or an active fragment thereof, or any combination thereof. In yet another aspect of this embodiment, a BoNT/A comprising a BoNT/A enzymatic domain of amino acids 1-448 from SEQ ID NO: 1 or an active fragment thereof, a BoNT/A translocation domain of amino acids 449-860 from SEQ ID NO: 1 or an active fragment thereof, a BoNT/A binding domain of amino acids 861-1296 from SEQ ID NO: 1 or an active fragment thereof, and any combination thereof.

In other aspects of this embodiment, a polynucleotide molecule encodes a BoNT/A comprising a polypeptide having, e.g., at least 70% amino acid identity with SEQ ID NO: 1, at least 75% amino acid identity with the SEQ ID NO: 1, at least 80% amino acid identity with SEQ ID NO: 1, at least 85% amino acid identity with SEQ ID NO: 1, at least 90% amino acid identity with SEQ ID NO: 1 or at least 95% amino acid identity with SEQ ID NO: 1. In yet other aspects of this embodiment, a polynucleotide molecule encodes a BoNT/A comprising a polypeptide having, e.g., at most 70% amino acid identity with SEQ ID NO: 1, at most 75% amino acid identity with the SEQ ID NO: 1, at most 80% amino acid identity with SEQ ID NO: 1, at most 85% amino acid identity with SEQ ID NO: 1, at most 90% amino acid identity with SEQ ID NO: 1 or at most 95% amino acid identity with SEQ ID NO: 1.

In other aspects of this embodiment, a polynucleotide molecule encodes a BoNT/A comprising a polypeptide having, e.g., at most one, two, three, four, five, six, seven, eight, nine, 10, 20, 30, 40, 50, 100, 200 or 500 non-contiguous amino acid substitutions relative to SEQ ID NO: 1. In other aspects of this embodiment, a polynucleotide molecule encodes a BoNT/A comprising a polypeptide having, e.g., at least one, two, three, four, five, six, seven, eight, nine, 10, 20, 30, 40, 50, 100, 200 or 500 non-contiguous amino acid substitutions relative to SEQ ID NO: 1. In yet other aspects of this embodiment, a polynucleotide molecule encodes a BoNT/A comprising a polypeptide having, e.g., at most one, two, three, four, five, six, seven, eight, nine, 10, 20, 30, 40, 50, 100, 200 or 500 non-contiguous amino acid deletions relative to SEQ ID NO: 1. In other aspects of this embodiment, a polynucleotide molecule encodes a BoNT/A comprising a polypeptide having, e.g., at least one, two, three, four, five, six, seven, eight, nine, 10, 20, 30, 40, 50, 100, 200 or 500 non-contiguous amino acid deletions relative to SEQ ID NO: 1. In still other aspects of this embodiment, a polynucleotide molecule encodes a BoNT/A comprising a polypeptide having, e.g., at most one, two, three, four, five, six, seven, eight, nine, 10, 20, 30, 40, 50, 100, 200 or 500 non-contiguous amino acid additions relative to SEQ ID NO: 1. In other aspects of this embodiment, a polynucleotide molecule encodes a BoNT/A comprising a polypeptide having, e.g., at least one, two, three, four, five, six, seven, eight, nine, 10, 20, 30, 40, 50, 100, 200 or 500 non-contiguous amino acid additions relative to SEQ ID NO: 1.

In other aspects of this embodiment, a polynucleotide molecule encodes a BoNT/A comprising a polypeptide having, e.g., at most one, two, three, four, five, six, seven, eight, nine, 10, 20, 30, 40, 50, 100, 200 or 500 contiguous amino acid substitutions relative to SEQ ID NO: 1. In other aspects of this embodiment, a polynucleotide molecule encodes a BoNT/A comprising a polypeptide having, e.g., at least one, two, three, four, five, six, seven, eight, nine, 10, 20, 30, 40, 50, 100, 200 or 500 contiguous amino acid substitutions relative to SEQ ID NO: 1. In yet other aspects of this embodiment, a polynucleotide molecule encodes a BoNT/A comprising a polypeptide having, e.g., at most one, two, three, four, five, six, seven, eight, nine, 10, 20, 30, 40, 50, 100, 200 or 500 contiguous amino acid deletions relative to SEQ ID NO: 1. In other aspects of this embodiment, a polynucleotide molecule encodes a BoNT/A comprising a polypeptide having, e.g., at least one, two, three, four, five, six, seven, eight, nine, 10, 20, 30, 40, 50, 100, 200 or 500 contiguous amino acid deletions relative to SEQ ID NO: 1. In still other aspects of this embodiment, a polynucleotide molecule encodes a BoNT/A comprising a polypeptide having, e.g., at most one, two, three, four, five, six, seven, eight, nine, 10, 20, 30, 40, 50, 100, 200 or 500 contiguous amino acid additions relative to SEQ ID NO: 1. In other aspects of this embodiment, a polynucleotide molecule encodes a BoNT/A comprising a polypeptide having, e.g., at least one, two, three, four, five, six, seven, eight, nine, 10, 20, 30, 40, 50, 100, 200 or 500 contiguous amino acid additions relative to SEQ ID NO: 1.

In another embodiment, a polynucleotide molecule encodes a Clostridial toxin comprising a BoNT/B. In an aspect of this embodiment, a polynucleotide molecule encodes a BoNT/B comprising a BoNT/B enzymatic domain, a BoNT/B translocation domain and a BoNT/B binding domain. In another aspect of this embodiment, a polynucleotide molecule encodes a BoNT/B comprising SEQ ID NO: 2. In another aspect of this embodiment, a polynucleotide molecule encodes a BoNT/B comprising a naturally occurring BoNT/B variant, such as, e.g., a BoNT/B isoform or a BoNT/B subtype. In another aspect of this embodiment, a polynucleotide molecule encodes a BoNT/B comprising a naturally occurring BoNT/B variant of SEQ ID NO: 2, such as, e.g., a BoNT/B isoform of SEQ ID NO: 2 or a BoNT/B subtype of SEQ ID NO: 2. In still another aspect of this embodiment, a polynucleotide molecule encodes a BoNT/B comprising a non-naturally occurring BoNT/B variant, such as, e.g., a conservative BoNT/B variant, a non-conservative BoNT/B variant or an active BoNT/B fragment, or any combination thereof. In still another aspect of this embodiment, a polynucleotide molecule encodes a BoNT/B comprising a non-naturally occurring BoNT/B variant of SEQ ID NO: 2, such as, e.g., a conservative BoNT/B variant of SEQ ID NO: 2, a non-conservative BoNT/B variant of SEQ ID NO: 2 or an active BoNT/B fragment of SEQ ID NO: 2, or any combination thereof. In yet another aspect of this embodiment, a BoNT/B comprising a BoNT/B enzymatic domain or an active fragment thereof, a BoNT/B translocation domain or active fragment thereof, a BoNT/B binding domain or active fragment thereof, and any combination thereof. In yet another aspect of this embodiment, a BoNT/B comprising a BoNT/B enzymatic domain of amino acids 1-441 from SEQ ID NO: 2 or active fragment thereof, a BoNT/B translocation domain of amino acids 442-847 from SEQ ID NO: 2 or active fragment thereof, a BoNT/B binding domain of amino acids 848-1291 from SEQ ID NO: 2 or active fragment thereof, and any combination thereof.

In other aspects of this embodiment, a polynucleotide molecule encodes a BoNT/B comprising a polypeptide having, e.g., at least 70% amino acid identity with SEQ ID NO: 2, at least 75% amino acid identity with the SEQ ID NO: 2, at least 80% amino acid identity with SEQ ID NO: 2, at least 85% amino acid identity with SEQ ID NO: 2, at least 90% amino acid identity with SEQ ID NO: 2 or at least 95% amino acid identity with SEQ ID NO: 2. In yet other aspects of this embodiment, a polynucleotide molecule encodes a BoNT/B comprising a polypeptide having, e.g., at most 70% amino acid identity with SEQ ID NO: 2, at most 75% amino acid identity with the SEQ ID NO: 2, at most 80% amino acid identity with SEQ ID NO: 2, at most 85% amino acid identity with SEQ ID NO: 2, at most 90% amino acid identity with SEQ ID NO: 2 or at most 95% amino acid identity with SEQ ID NO: 2.

In other aspects of this embodiment, a polynucleotide molecule encodes a BoNT/B comprising a polypeptide having, e.g., at most one, two, three, four, five, six, seven, eight, nine, 10, 20, 30, 40, 50, 100, 200 or 500 non-contiguous amino acid substitutions relative to SEQ ID NO: 2. In other aspects of this embodiment, a polynucleotide molecule encodes a BoNT/B comprising a polypeptide having, e.g., at least one, two, three, four, five, six, seven, eight, nine, 10, 20, 30, 40, 50, 100, 200 or 500 non-contiguous amino acid substitutions relative to SEQ ID NO: 2. In yet other aspects of this embodiment, a polynucleotide molecule encodes a BoNT/B comprising a polypeptide having, e.g., at most one, two, three, four, five, six, seven, eight, nine, 10, 20, 30, 40, 50, 100, 200 or 500 non-contiguous amino acid deletions relative to SEQ ID NO: 2. In other aspects of this embodiment, a polynucleotide molecule encodes a BoNT/B comprising a polypeptide having, e.g., at least one, two, three, four, five, six, seven, eight, nine, 10, 20, 30, 40, 50, 100, 200 or 500 non-contiguous amino acid deletions relative to SEQ ID NO: 2. In still other aspects of this embodiment, a polynucleotide molecule encodes a BoNT/B comprising a polypeptide having, e.g., at most one, two, three, four, five, six, seven, eight, nine, 10, 20, 30, 40, 50, 100, 200 or 500 non-contiguous amino acid additions relative to SEQ ID NO: 2. In other aspects of this embodiment, a polynucleotide molecule encodes a BoNT/B comprising a polypeptide having, e.g., at least one, two, three, four, five, six, seven, eight, nine, 10, 20, 30, 40, 50, 100, 200 or 500 non-contiguous amino acid additions relative to SEQ ID NO: 2.

In other aspects of this embodiment, a polynucleotide molecule encodes a BoNT/B comprising a polypeptide having, e.g., at most one, two, three, four, five, six, seven, eight, nine, 10, 20, 30, 40, 50, 100, 200 or 500 contiguous amino acid substitutions relative to SEQ ID NO: 2. In other aspects of this embodiment, a polynucleotide molecule encodes a BoNT/B comprising a polypeptide having, e.g., at least one, two, three, four, five, six, seven, eight, nine, 10, 20, 30, 40, 50, 100, 200 or 500 contiguous amino acid substitutions relative to SEQ ID NO: 2. In yet other aspects of this embodiment, a polynucleotide molecule encodes a BoNT/B comprising a polypeptide having, e.g., at most one, two, three, four, five, six, seven, eight, nine, 10, 20, 30, 40, 50, 100, 200 or 500 contiguous amino acid deletions relative to SEQ ID NO: 2. In other aspects of this embodiment, a polynucleotide molecule encodes a BoNT/B comprising a polypeptide having, e.g., at least one, two, three, four, five, six, seven, eight, nine, 10, 20, 30, 40, 50, 100, 200 or 500 contiguous amino acid deletions relative to SEQ ID NO: 2. In still other aspects of this embodiment, a polynucleotide molecule encodes a BoNT/B comprising a polypeptide having, e.g., at most one, two, three, four, five, six, seven, eight, nine, 10, 20, 30, 40, 50, 100, 200 or 500 contiguous amino acid additions relative to SEQ ID NO: 2. In other aspects of this embodiment, a polynucleotide molecule encodes a BoNT/B comprising a polypeptide having, e.g., at least one, two, three, four, five, six, seven, eight, nine, 10, 20, 30, 40, 50, 100, 200 or 500 contiguous amino acid additions relative to SEQ ID NO: 2.

In another embodiment, a polynucleotide molecule encodes a Clostridial toxin comprising a BoNT/C1. In an aspect of this embodiment, a polynucleotide molecule encodes a BoNT/C1 comprising a BoNT/C1 enzymatic domain, a BoNT/C1 translocation domain and a BoNT/C1 binding domain. In another aspect of this embodiment, a polynucleotide molecule encodes a BoNT/C1 comprising SEQ ID NO: 3. In another aspect of this embodiment, a polynucleotide molecule encodes a BoNT/C1 comprising a naturally occurring BoNT/C1 variant, such as, e.g., a BoNT/C1 isoform or a BoNT/C1 subtype. In another aspect of this embodiment, a polynucleotide molecule encodes a BoNT/C1 comprising a naturally occurring BoNT/C1 variant of SEQ ID NO: 3, such as, e.g., a BoNT/C1 isoform of SEQ ID NO: 3 or a BoNT/C1 subtype of SEQ ID NO: 3. In still another aspect of this embodiment, a polynucleotide molecule encodes a BoNT/C1 comprising a non-naturally occurring BoNT/C1 variant, such as, e.g., a conservative BoNT/C1 variant, a non-conservative BoNT/C1 variant or an active BoNT/C1 fragment, or any combination thereof. In still another aspect of this embodiment, a polynucleotide molecule encodes a BoNT/C1 comprising a non-naturally occurring BoNT/C1 variant of SEQ ID NO: 3, such as, e.g., a conservative BoNT/C1 variant of SEQ ID NO: 3, a non-conservative BoNT/C1 variant of SEQ ID NO: 3 or an active BoNT/C1 fragment of SEQ ID NO: 3, or any combination thereof. In yet another aspect of this embodiment, a polynucleotide molecule encodes a BoNT/C1 comprising a BoNT/C1 enzymatic domain or active fragment thereof, a BoNT/C1 translocation domain or active fragment thereof, a BoNT/C1 binding domain or active fragment thereof, and any combination thereof. In yet another aspect of this embodiment, a polynucleotide molecule encodes a BoNT/C1 comprising a BoNT/C1 enzymatic domain of amino acid 1-449 from SEQ ID NO: 3 or active fragment thereof, a BoNT/C1 translocation domain of amino acids 450-855 from SEQ ID NO: 3 or active fragment thereof, a BoNT/C1 binding domain of amino acids 856-1291 from SEQ ID NO: 3 or active fragment thereof, and any combination thereof.

In other aspects of this embodiment, a polynucleotide molecule encodes a BoNT/C1 comprising a polypeptide having, e.g., at least 70% amino acid identity with SEQ ID NO: 3, at least 75% amino acid identity with the SEQ ID NO: 3, at least 80% amino acid identity with SEQ ID NO: 3, at least 85% amino acid identity with SEQ ID NO: 3, at least 90% amino acid identity with SEQ ID NO: 3 or at least 95% amino acid identity with SEQ ID NO: 3. In yet other aspects of this embodiment, a polynucleotide molecule encodes a BoNT/C1 comprising a polypeptide having, e.g., at most 70% amino acid identity with SEQ ID NO: 3, at most 75% amino acid identity with the SEQ ID NO: 3, at most 80% amino acid identity with SEQ ID NO: 3, at most 85% amino acid identity with SEQ ID NO: 3, at most 90% amino acid identity with SEQ ID NO: 3 or at most 95% amino acid identity with SEQ ID NO: 3.

In other aspects of this embodiment, a polynucleotide molecule encodes a BoNT/C1 comprising a polypeptide having, e.g., at most one, two, three, four, five, six, seven, eight, nine, 10, 20, 30, 40, 50, 100, 200 or 500 non-contiguous amino acid substitutions relative to SEQ ID NO: 3. In other aspects of this embodiment, a polynucleotide molecule encodes a BoNT/C1 comprising a polypeptide having, e.g., at least one, two, three, four, five, six, seven, eight, nine, 10, 20, 30, 40, 50, 100, 200 or 500 non-contiguous amino acid substitutions relative to SEQ ID NO: 3. In yet other aspects of this embodiment, a polynucleotide molecule encodes a BoNT/C1 comprising a polypeptide having, e.g., at most one, two, three, four, five, six, seven, eight, nine, 10, 20, 30, 40, 50, 100, 200 or 500 non-contiguous amino acid deletions relative to SEQ ID NO: 3. In other aspects of this embodiment, a polynucleotide molecule encodes a BoNT/C1 comprising a polypeptide having, e.g., at least one, two, three, four, five, six, seven, eight, nine, 10, 20, 30, 40, 50, 100, 200 or 500 non-contiguous amino acid deletions relative to SEQ ID NO: 3. In still other aspects of this embodiment, a polynucleotide molecule encodes a BoNT/C1 comprising a polypeptide having, e.g., at most one, two, three, four, five, six, seven, eight, nine, 10, 20, 30, 40, 50, 100, 200 or 500 non-contiguous amino acid additions relative to SEQ ID NO: 3. In other aspects of this embodiment, a polynucleotide molecule encodes a BoNT/C1 comprising a polypeptide having, e.g., at least one, two, three, four, five, six, seven, eight, nine, 10, 20, 30, 40, 50, 100, 200 or 500 non-contiguous amino acid additions relative to SEQ ID NO: 3.

In other aspects of this embodiment, a polynucleotide molecule encodes a BoNT/C1 comprising a polypeptide having, e.g., at most one, two, three, four, five, six, seven, eight, nine, 10, 20, 30, 40, 50, 100, 200 or 500 contiguous amino acid substitutions relative to SEQ ID NO: 3. In other aspects of this embodiment, a polynucleotide molecule encodes a BoNT/C1 comprising a polypeptide having, e.g., at least one, two, three, four, five, six, seven, eight, nine, 10, 20, 30, 40, 50, 100, 200 or 500 contiguous amino acid substitutions relative to SEQ ID NO: 3. In yet other aspects of this embodiment, a polynucleotide molecule encodes a BoNT/C1 comprising a polypeptide having, e.g., at most one, two, three, four, five, six, seven, eight, nine, 10, 20, 30, 40, 50, 100, 200 or 500 contiguous amino acid deletions relative to SEQ ID NO: 3. In other aspects of this embodiment, a polynucleotide molecule encodes a BoNT/C1 comprising a polypeptide having, e.g., at least one, two, three, four, five, six, seven, eight, nine, 10, 20, 30, 40, 50, 100, 200 or 500 contiguous amino acid deletions relative to SEQ ID NO: 3. In still other aspects of this embodiment, a polynucleotide molecule encodes a BoNT/C1 comprising a polypeptide having, e.g., at most one, two, three, four, five, six, seven, eight, nine, 10, 20, 30, 40, 50, 100, 200 or 500 contiguous amino acid additions relative to SEQ ID NO: 3. In other aspects of this embodiment, a polynucleotide molecule encodes a BoNT/C1 comprising a polypeptide having, e.g., at least one, two, three, four, five, six, seven, eight, nine, 10, 20, 30, 40, 50, 100, 200 or 500 contiguous amino acid additions relative to SEQ ID NO: 3.

In another embodiment, a polynucleotide molecule encodes a Clostridial toxin comprising a BoNT/D. In an aspect of this embodiment, a polynucleotide molecule encodes a BoNT/D comprising a BoNT/D enzymatic domain, a BoNT/D translocation domain and a BoNT/D binding domain. In another aspect of this embodiment, a polynucleotide molecule encodes a BoNT/D comprising SEQ ID NO: 4. In another aspect of this embodiment, a polynucleotide molecule encodes a BoNT/D comprising a naturally occurring BoNT/D variant, such as, e.g., a BoNT/D isoform or a BoNT/D subtype. In another aspect of this embodiment, a polynucleotide molecule encodes a BoNT/D comprising a naturally occurring BoNT/D variant of SEQ ID NO: 4, such as, e.g., a BoNT/D isoform of SEQ ID NO: 4 or a BoNT/D subtype of SEQ ID NO: 4. In still another aspect of this embodiment, a polynucleotide molecule encodes a BoNT/D comprising a non-naturally occurring BoNT/D variant, such as, e.g., a conservative BoNT/D variant, a non-conservative BoNT/D variant or an active BoNT/D fragment, or any combination thereof. In still another aspect of this embodiment, a polynucleotide molecule encodes a BoNT/D comprising a non-naturally occurring BoNT/D variant of SEQ ID NO: 4, such as, e.g., a conservative BoNT/D variant of SEQ ID NO: 4, a non-conservative BoNT/D variant of SEQ ID NO: 4 or an active BoNT/D fragment of SEQ ID NO: 4, or any combination thereof. In yet another aspect of this embodiment, a polynucleotide molecule encodes a BoNT/D comprising a BoNT/D enzymatic domain or an active fragment thereof, a BoNT/D translocation domain or an active fragment thereof, a BoNT/D binding domain or an active fragment thereof, or any combination thereof. In yet another aspect of this embodiment, a BoNT/D comprising a BoNT/D enzymatic domain of amino acids 1-442 from SEQ ID NO: 4 or an active fragment thereof, a BoNT/D translocation domain of amino acids 443-851 from SEQ ID NO: 4 or an active fragment thereof, a BoNT/D binding domain of amino acids 852-1276 from SEQ ID NO: 4 or an active fragment thereof, and any combination thereof.

In other aspects of this embodiment, a polynucleotide molecule encodes a BoNT/D comprising a polypeptide having, e.g., at least 70% amino acid identity with SEQ ID NO: 4, at least 75% amino acid identity with the SEQ ID NO: 4, at least 80% amino acid identity with SEQ ID NO: 4, at least 85% amino acid identity with SEQ ID NO: 4, at least 90% amino acid identity with SEQ ID NO: 4 or at least 95% amino acid identity with SEQ ID NO: 4. In yet other aspects of this embodiment, a polynucleotide molecule encodes a BoNT/D comprising a polypeptide having, e.g., at most 70% amino acid identity with SEQ ID NO: 4, at most 75% amino acid identity with the SEQ ID NO: 4, at most 80% amino acid identity with SEQ ID NO: 4, at most 85% amino acid identity with SEQ ID NO: 4, at most 90% amino acid identity with SEQ ID NO: 4 or at most 95% amino acid identity with SEQ ID NO: 4.

In other aspects of this embodiment, a polynucleotide molecule encodes a BoNT/D comprising a polypeptide having, e.g., at most one, two, three, four, five, six, seven, eight, nine, 10, 20, 30, 40, 50, 100, 200 or 500 non-contiguous amino acid substitutions relative to SEQ ID NO: 4. In other aspects of this embodiment, a polynucleotide molecule encodes a BoNT/D comprising a polypeptide having, e.g., at least one, two, three, four, five, six, seven, eight, nine, 10, 20, 30, 40, 50, 100, 200 or 500 non-contiguous amino acid substitutions relative to SEQ ID NO: 4. In yet other aspects of this embodiment, a polynucleotide molecule encodes a BoNT/D comprising a polypeptide having, e.g., at most one, two, three, four, five, six, seven, eight, nine, 10, 20, 30, 40, 50, 100, 200 or 500 non-contiguous amino acid deletions relative to SEQ ID NO: 4. In other aspects of this embodiment, a polynucleotide molecule encodes a BoNT/D comprising a polypeptide having, e.g., at least one, two, three, four, five, six, seven, eight, nine, 10, 20, 30, 40, 50, 100, 200 or 500 non-contiguous amino acid deletions relative to SEQ ID NO: 4. In still other aspects of this embodiment, a polynucleotide molecule encodes a BoNT/D comprising a polypeptide having, e.g., at most one, two, three, four, five, six, seven, eight, nine, 10, 20, 30, 40, 50, 100, 200 or 500 non-contiguous amino acid additions relative to SEQ ID NO: 4. In other aspects of this embodiment, a polynucleotide molecule encodes a BoNT/D comprising a polypeptide having, e.g., at least one, two, three, four, five, six, seven, eight, nine, 10, 20, 30, 40, 50, 100, 200 or 500 non-contiguous amino acid additions relative to SEQ ID NO: 4.

In other aspects of this embodiment, a polynucleotide molecule encodes a BoNT/D comprising a polypeptide having, e.g., at most one, two, three, four, five, six, seven, eight, nine, 10, 20, 30, 40, 50, 100, 200 or 500 contiguous amino acid substitutions relative to SEQ ID NO: 4. In other aspects of this embodiment, a polynucleotide molecule encodes a BoNT/D comprising a polypeptide having, e.g., at least one, two, three, four, five, six, seven, eight, nine, 10, 20, 30, 40, 50, 100, 200 or 500 contiguous amino acid substitutions relative to SEQ ID NO: 4. In yet other aspects of this embodiment, a polynucleotide molecule encodes a BoNT/D comprising a polypeptide having, e.g., at most one, two, three, four, five, six, seven, eight, nine, 10, 20, 30, 40, 50, 100, 200 or 500 contiguous amino acid deletions relative to SEQ ID NO: 4. In other aspects of this embodiment, a polynucleotide molecule encodes a BoNT/D comprising a polypeptide having, e.g., at least one, two, three, four, five, six, seven, eight, nine, 10, 20, 30, 40, 50, 100, 200 or 500 contiguous amino acid deletions relative to SEQ ID NO: 4. In still other aspects of this embodiment, a polynucleotide molecule encodes a BoNT/D comprising a polypeptide having, e.g., at most one, two, three, four, five, six, seven, eight, nine, 10, 20, 30, 40, 50, 100, 200 or 500 contiguous amino acid additions relative to SEQ ID NO: 4. In other aspects of this embodiment, a polynucleotide molecule encodes a BoNT/D comprising a polypeptide having, e.g., at least one, two, three, four, five, six, seven, eight, nine, 10, 20, 30, 40, 50, 100, 200 or 500 contiguous amino acid additions relative to SEQ ID NO: 4.

In another embodiment, a polynucleotide molecule encodes a Clostridial toxin comprising a BoNT/E. In an aspect of this embodiment, a polynucleotide molecule encodes a BoNT/E comprising a BoNT/E enzymatic domain, a BoNT/E translocation domain and a BoNT/E binding domain. In another aspect of this embodiment, a polynucleotide molecule encodes a BoNT/E comprising SEQ ID NO: 5. In another aspect of this embodiment, a polynucleotide molecule encodes a BoNT/E comprising a naturally occurring BoNT/E variant, such as, e.g., a BoNT/E isoform or a BoNT/E subtype. In another aspect of this embodiment, a polynucleotide molecule encodes a BoNT/E comprising a naturally occurring BoNT/E variant of SEQ ID NO: 5, such as, e.g., a BoNT/E isoform of SEQ ID NO: 5 or a BoNT/E subtype of SEQ ID NO: 5. In still another aspect of this embodiment, a polynucleotide molecule encodes a BoNT/E comprising a non-naturally occurring BoNT/E variant, such as, e.g., a conservative BoNT/E variant, a non-conservative BoNT/E variant or an active BoNT/E fragment, or any combination thereof. In still another aspect of this embodiment, a polynucleotide molecule encodes a BoNT/E comprising a non-naturally occurring BoNT/E variant of SEQ ID NO: 5, such as, e.g., a conservative BoNT/E variant of SEQ ID NO: 5, a non-conservative BoNT/E variant of SEQ ID NO: 5 or an active BoNT/E fragment of SEQ ID NO: 5, or any combination thereof. In yet another aspect of this embodiment, a BoNT/E comprising a BoNT/E enzymatic domain or an active fragment thereof, a BoNT/E translocation domain or active fragment thereof, a BoNT/E binding domain or active fragment thereof, and any combination thereof. In yet another aspect of this embodiment, a BoNT/E comprising a BoNT/E enzymatic domain of amino acids 1-422 from SEQ ID NO: 5 or active fragment thereof, a BoNT/E translocation domain of amino acids 423-834 from SEQ ID NO: 5 or active fragment thereof, a BoNT/E binding domain of amino acids 835-1252 from SEQ ID NO: 5 or active fragment thereof, and any combination thereof.

In other aspects of this embodiment, a polynucleotide molecule encodes a BoNT/E comprising a polypeptide having, e.g., at least 70% amino acid identity with SEQ ID NO: 5, at least 75% amino acid identity with the SEQ ID NO: 5, at least 80% amino acid identity with SEQ ID NO: 5, at least 85% amino acid identity with SEQ ID NO: 5, at least 90% amino acid identity with SEQ ID NO: 5 or at least 95% amino acid identity with SEQ ID NO: 5. In yet other aspects of this embodiment, a polynucleotide molecule encodes a BoNT/E comprising a polypeptide having, e.g., at most 70% amino acid identity with SEQ ID NO: 5, at most 75% amino acid identity with the SEQ ID NO: 5, at most 80% amino acid identity with SEQ ID NO: 5, at most 85% amino acid identity with SEQ ID NO: 5, at most 90% amino acid identity with SEQ ID NO: 5 or at most 95% amino acid identity with SEQ ID NO: 5.

In other aspects of this embodiment, a polynucleotide molecule encodes a BoNT/E comprising a polypeptide having, e.g., at most one, two, three, four, five, six, seven, eight, nine, 10, 20, 30, 40, 50, 100, 200 or 500 non-contiguous amino acid substitutions relative to SEQ ID NO: 5. In other aspects of this embodiment, a polynucleotide molecule encodes a BoNT/E comprising a polypeptide having, e.g., at least one, two, three, four, five, six, seven, eight, nine, 10, 20, 30, 40, 50, 100, 200 or 500 non-contiguous amino acid substitutions relative to SEQ ID NO: 5. In yet other aspects of this embodiment, a polynucleotide molecule encodes a BoNT/E comprising a polypeptide having, e.g., at most one, two, three, four, five, six, seven, eight, nine, 10, 20, 30, 40, 50, 100, 200 or 500 non-contiguous amino acid deletions relative to SEQ ID NO: 5. In other aspects of this embodiment, a polynucleotide molecule encodes a BoNT/E comprising a polypeptide having, e.g., at least one, two, three, four, five, six, seven, eight, nine, 10, 20, 30, 40, 50, 100, 200 or 500 non-contiguous amino acid deletions relative to SEQ ID NO: 5. In still other aspects of this embodiment, a polynucleotide molecule encodes a BoNT/E comprising a polypeptide having, e.g., at most one, two, three, four, five, six, seven, eight, nine, 10, 20, 30, 40, 50, 100, 200 or 500 non-contiguous amino acid additions relative to SEQ ID NO: 5. In other aspects of this embodiment, a polynucleotide molecule encodes a BoNT/E comprising a polypeptide having, e.g., at least one, two, three, four, five, six, seven, eight, nine, 10, 20, 30, 40, 50, 100, 200 or 500 non-contiguous amino acid additions relative to SEQ ID NO: 5.

In other aspects of this embodiment, a polynucleotide molecule encodes a BoNT/E comprising a polypeptide having, e.g., at most one, two, three, four, five, six, seven, eight, nine, 10, 20, 30, 40, 50, 100, 200 or 500 contiguous amino acid substitutions relative to SEQ ID NO: 5. In other aspects of this embodiment, a polynucleotide molecule encodes a BoNT/E comprising a polypeptide having, e.g., at least one, two, three, four, five, six, seven, eight, nine, 10, 20, 30, 40, 50, 100, 200 or 500 contiguous amino acid substitutions relative to SEQ ID NO: 5. In yet other aspects of this embodiment, a polynucleotide molecule encodes a BoNT/E comprising a polypeptide having, e.g., at most one, two, three, four, five, six, seven, eight, nine, 10, 20, 30, 40, 50, 100, 200 or 500 contiguous amino acid deletions relative to SEQ ID NO: 5. In other aspects of this embodiment, a polynucleotide molecule encodes a BoNT/E comprising a polypeptide having, e.g., at least one, two, three, four, five, six, seven, eight, nine, 10, 20, 30, 40, 50, 100, 200 or 500 contiguous amino acid deletions relative to SEQ ID NO: 5. In still other aspects of this embodiment, a polynucleotide molecule encodes a BoNT/E comprising a polypeptide having, e.g., at most one, two, three, four, five, six, seven, eight, nine, 10, 20, 30, 40, 50, 100, 200 or 500 contiguous amino acid additions relative to SEQ ID NO: 5. In other aspects of this embodiment, a polynucleotide molecule encodes a BoNT/E comprising a polypeptide having, e.g., at least one, two, three, four, five, six, seven, eight, nine, 10, 20, 30, 40, 50, 100, 200 or 500 contiguous amino acid additions relative to SEQ ID NO: 5.

In another embodiment, a polynucleotide molecule encodes a Clostridial toxin comprising a BoNT/F. In an aspect of this embodiment, a polynucleotide molecule encodes a BoNT/F comprising a BoNT/F enzymatic domain, a BoNT/F translocation domain and a BoNT/F binding domain. In another aspect of this embodiment, a polynucleotide molecule encodes a BoNT/F comprising SEQ ID NO: 6. In another aspect of this embodiment, a polynucleotide molecule encodes a BoNT/F comprising a naturally occurring BoNT/F variant, such as, e.g., a BoNT/F isoform or a BoNT/F subtype. In another aspect of this embodiment, a polynucleotide molecule encodes a BoNT/F comprising a naturally occurring BoNT/F variant of SEQ ID NO: 6, such as, e.g., a BoNT/F isoform of SEQ ID NO: 6 or a BoNT/F subtype of SEQ ID NO: 6. In still another aspect of this embodiment, a polynucleotide molecule encodes a BoNT/F comprising a non-naturally occurring BoNT/F variant, such as, e.g., a conservative BoNT/F variant, a non-conservative BoNT/F variant or an active BoNT/F fragment, or any combination thereof. In still another aspect of this embodiment, a polynucleotide molecule encodes a BoNT/F comprising a non-naturally occurring BoNT/F variant of SEQ ID NO: 6, such as, e.g., a conservative BoNT/F variant of SEQ ID NO: 6, a non-conservative BoNT/F variant of SEQ ID NO: 6 or an active BoNT/F fragment of SEQ ID NO: 6, or any combination thereof. In yet another aspect of this embodiment, a polynucleotide molecule encodes a BoNT/F comprising a BoNT/F enzymatic domain or active fragment thereof, a BoNT/F translocation domain or active fragment thereof, a BoNT/F binding domain or active fragment thereof, and any combination thereof. In yet another aspect of this embodiment, a polynucleotide molecule encodes a BoNT/F comprising a BoNT/F enzymatic domain of amino acid 1-436 from SEQ ID NO: 6 or active fragment thereof, a BoNT/F translocation domain of amino acids 437-852 from SEQ ID NO: 6 or active fragment thereof, a BoNT/F binding domain of amino acids 853-1274 from SEQ ID NO: 6 or active fragment thereof, and any combination thereof.

In other aspects of this embodiment, a polynucleotide molecule encodes a BoNT/F comprising a polypeptide having, e.g., at least 70% amino acid identity with SEQ ID NO: 6, at least 75% amino acid identity with the SEQ ID NO: 6, at least 80% amino acid identity with SEQ ID NO: 6, at least 85% amino acid identity with SEQ ID NO: 6, at least 90% amino acid identity with SEQ ID NO: 6 or at least 95% amino acid identity with SEQ ID NO: 6. In yet other aspects of this embodiment, a polynucleotide molecule encodes a BoNT/F comprising a polypeptide having, e.g., at most 70% amino acid identity with SEQ ID NO: 6, at most 75% amino acid identity with the SEQ ID NO: 6, at most 80% amino acid identity with SEQ ID NO: 6, at most 85% amino acid identity with SEQ ID NO: 6, at most 90% amino acid identity with SEQ ID NO: 6 or at most 95% amino acid identity with SEQ ID NO: 6.

In other aspects of this embodiment, a polynucleotide molecule encodes a BoNT/F comprising a polypeptide having, e.g., at most one, two, three, four, five, six, seven, eight, nine, 10, 20, 30, 40, 50, 100, 200 or 500 non-contiguous amino acid substitutions relative to SEQ ID NO: 6. In other aspects of this embodiment, a polynucleotide molecule encodes a BoNT/F comprising a polypeptide having, e.g., at least one, two, three, four, five, six, seven, eight, nine, 10, 20, 30, 40, 50, 100, 200 or 500 non-contiguous amino acid substitutions relative to SEQ ID NO: 6. In yet other aspects of this embodiment, a polynucleotide molecule encodes a BoNT/F comprising a polypeptide having, e.g., at most one, two, three, four, five, six, seven, eight, nine, 10, 20, 30, 40, 50, 100, 200 or 500 non-contiguous amino acid deletions relative to SEQ ID NO: 6. In other aspects of this embodiment, a polynucleotide molecule encodes a BoNT/F comprising a polypeptide having, e.g., at least one, two, three, four, five, six, seven, eight, nine, 10, 20, 30, 40, 50, 100, 200 or 500 non-contiguous amino acid deletions relative to SEQ ID NO: 6. In still other aspects of this embodiment, a polynucleotide molecule encodes a BoNT/F comprising a polypeptide having, e.g., at most one, two, three, four, five, six, seven, eight, nine, 10, 20, 30, 40, 50, 100, 200 or 500 non-contiguous amino acid additions relative to SEQ ID NO: 6. In other aspects of this embodiment, a polynucleotide molecule encodes a BoNT/F comprising a polypeptide having, e.g., at least one, two, three, four, five, six, seven, eight, nine, 10, 20, 30, 40, 50, 100, 200 or 500 non-contiguous amino acid additions relative to SEQ ID NO: 6.

In other aspects of this embodiment, a polynucleotide molecule encodes a BoNT/F comprising a polypeptide having, e.g., at most one, two, three, four, five, six, seven, eight, nine, 10, 20, 30, 40, 50, 100, 200 or 500 contiguous amino acid substitutions relative to SEQ ID NO: 6. In other aspects of this embodiment, a polynucleotide molecule encodes a BoNT/F comprising a polypeptide having, e.g., at least one, two, three, four, five, six, seven, eight, nine, 10, 20, 30, 40, 50, 100, 200 or 500 contiguous amino acid substitutions relative to SEQ ID NO: 6. In yet other aspects of this embodiment, a polynucleotide molecule encodes a BoNT/F comprising a polypeptide having, e.g., at most one, two, three, four, five, six, seven, eight, nine, 10, 20, 30, 40, 50, 100, 200 or 500 contiguous amino acid deletions relative to SEQ ID NO: 6. In other aspects of this embodiment, a polynucleotide molecule encodes a BoNT/F comprising a polypeptide having, e.g., at least one, two, three, four, five, six, seven, eight, nine, 10, 20, 30, 40, 50, 100, 200 or 500 contiguous amino acid deletions relative to SEQ ID NO: 6. In still other aspects of this embodiment, a polynucleotide molecule encodes a BoNT/F comprising a polypeptide having, e.g., at most one, two, three, four, five, six, seven, eight, nine, 10, 20, 30, 40, 50, 100, 200 or 500 contiguous amino acid additions relative to SEQ ID NO: 6. In other aspects of this embodiment, a polynucleotide molecule encodes a BoNT/F comprising a polypeptide having, e.g., at least one, two, three, four, five, six, seven, eight, nine, 10, 20, 30, 40, 50, 100, 200 or 500 contiguous amino acid additions relative to SEQ ID NO: 6.

In another embodiment, a polynucleotide molecule encodes a Clostridial toxin comprising a BoNT/G. In an aspect of this embodiment, a polynucleotide molecule encodes a BoNT/G comprising a BoNT/G enzymatic domain, a BoNT/G translocation domain and a BoNT/G binding domain. In another aspect of this embodiment, a polynucleotide molecule encodes a BoNT/G comprising SEQ ID NO: 7. In another aspect of this embodiment, a polynucleotide molecule encodes a BoNT/G comprising a naturally occurring BoNT/G variant, such as, e.g., a BoNT/G isoform or a BoNT/G subtype. In another aspect of this embodiment, a polynucleotide molecule encodes a BoNT/G comprising a naturally occurring BoNT/G variant of SEQ ID NO: 7, such as, e.g., a BoNT/G isoform of SEQ ID NO: 7 or a BoNT/G subtype of SEQ ID NO: 7. In still another aspect of this embodiment, a polynucleotide molecule encodes a BoNT/G comprising a non-naturally occurring BoNT/G variant, such as, e.g., a conservative BoNT/G variant, a non-conservative BoNT/G variant or an active BoNT/G fragment, or any combination thereof. In still another aspect of this embodiment, a polynucleotide molecule encodes a BoNT/D comprising a non-naturally occurring BoNT/G variant of SEQ ID NO: 7, such as, e.g., a conservative BoNT/G variant of SEQ ID NO: 7, a non-conservative BoNT/G variant of SEQ ID NO: 7 or an active BoNT/G fragment of SEQ ID NO: 7, or any combination thereof. In yet another aspect of this embodiment, a polynucleotide molecule encodes a BoNT/G comprising a BoNT/G enzymatic domain or an active fragment thereof, a BoNT/G translocation domain or an active fragment thereof, a BoNT/G binding domain or an active fragment thereof, or any combination thereof. In yet another aspect of this embodiment, a BoNT/G comprising a BoNT/G enzymatic domain of amino acids 1-442 from SEQ ID NO: 7 or an active fragment thereof, a BoNT/G translocation domain of amino acids 443-852 from SEQ ID NO: 7 or an active fragment thereof, a BoNT/G binding domain of amino acids 853-1297 from SEQ ID NO: 7 or an active fragment thereof, and any combination thereof.

In other aspects of this embodiment, a polynucleotide molecule encodes a BoNT/G comprising a polypeptide having, e.g., at least 70% amino acid identity with SEQ ID NO: 7, at least 75% amino acid identity with the SEQ ID NO: 7, at least 80% amino acid identity with SEQ ID NO: 7, at least 85% amino acid identity with SEQ ID NO: 7, at least 90% amino acid identity with SEQ ID NO: 7 or at least 95% amino acid identity with SEQ ID NO: 7. In yet other aspects of this embodiment, a polynucleotide molecule encodes a BoNT/G comprising a polypeptide having, e.g., at most 70% amino acid identity with SEQ ID NO: 7, at most 75% amino acid identity with the SEQ ID NO: 7, at most 80% amino acid identity with SEQ ID NO: 7, at most 85% amino acid identity with SEQ ID NO: 7, at most 90% amino acid identity with SEQ ID NO: 7 or at most 95% amino acid identity with SEQ ID NO: 7.

In other aspects of this embodiment, a polynucleotide molecule encodes a BoNT/G comprising a polypeptide having, e.g., at most one, two, three, four, five, six, seven, eight, nine, 10, 20, 30, 40, 50, 100, 200 or 500 non-contiguous amino acid substitutions relative to SEQ ID NO: 7. In other aspects of this embodiment, a polynucleotide molecule encodes a BoNT/G comprising a polypeptide having, e.g., at least one, two, three, four, five, six, seven, eight, nine, 10, 20, 30, 40, 50, 100, 200 or 500 non-contiguous amino acid substitutions relative to SEQ ID NO: 7. In yet other aspects of this embodiment, a polynucleotide molecule encodes a BoNT/G comprising a polypeptide having, e.g., at most one, two, three, four, five, six, seven, eight, nine, 10, 20, 30, 40, 50, 100, 200 or 500 non-contiguous amino acid deletions relative to SEQ ID NO: 7. In other aspects of this embodiment, a polynucleotide molecule encodes a BoNT/G comprising a polypeptide having, e.g., at least one, two, three, four, five, six, seven, eight, nine, 10, 20, 30, 40, 50, 100, 200 or 500 non-contiguous amino acid deletions relative to SEQ ID NO: 7. In still other aspects of this embodiment, a polynucleotide molecule encodes a BoNT/G comprising a polypeptide having, e.g., at most one, two, three, four, five, six, seven, eight, nine, 10, 20, 30, 40, 50, 100, 200 or 500 non-contiguous amino acid additions relative to SEQ ID NO: 7. In other aspects of this embodiment, a polynucleotide molecule encodes a BoNT/G comprising a polypeptide having, e.g., at least one, two, three, four, five, six, seven, eight, nine, 10, 20, 30, 40, 50, 100, 200 or 500 non-contiguous amino acid additions relative to SEQ ID NO: 7.

In other aspects of this embodiment, a polynucleotide molecule encodes a BoNT/G comprising a polypeptide having, e.g., at most one, two, three, four, five, six, seven, eight, nine, 10, 20, 30, 40, 50, 100, 200 or 500 contiguous amino acid substitutions relative to SEQ ID NO: 7. In other aspects of this embodiment, a polynucleotide molecule encodes a BoNT/G comprising a polypeptide having, e.g., at least one, two, three, four, five, six, seven, eight, nine, 10, 20, 30, 40, 50, 100, 200 or 500 contiguous amino acid substitutions relative to SEQ ID NO: 7. In yet other aspects of this embodiment, a polynucleotide molecule encodes a BoNT/G comprising a polypeptide having, e.g., at most one, two, three, four, five, six, seven, eight, nine, 10, 20, 30, 40, 50, 100, 200 or 500 contiguous amino acid deletions relative to SEQ ID NO: 7. In other aspects of this embodiment, a polynucleotide molecule encodes a BoNT/G comprising a polypeptide having, e.g., at least one, two, three, four, five, six, seven, eight, nine, 10, 20, 30, 40, 50, 100, 200 or 500 contiguous amino acid deletions relative to SEQ ID NO: 7. In still other aspects of this embodiment, a polynucleotide molecule encodes a BoNT/G comprising a polypeptide having, e.g., at most one, two, three, four, five, six, seven, eight, nine, 10, 20, 30, 40, 50, 100, 200 or 500 contiguous amino acid additions relative to SEQ ID NO: 7. In other aspects of this embodiment, a polynucleotide molecule encodes a BoNT/G comprising a polypeptide having, e.g., at least one, two, three, four, five, six, seven, eight, nine, 10, 20, 30, 40, 50, 100, 200 or 500 contiguous amino acid additions relative to SEQ ID NO: 7.

In another embodiment, a polynucleotide molecule encodes a Clostridial toxin comprising a TeNT. In an aspect of this embodiment, a polynucleotide molecule encodes a TeNT comprising a TeNT enzymatic domain, a TeNT translocation domain and a TeNT binding domain. In an aspect of this embodiment, a polynucleotide molecule encodes a TeNT comprising SEQ ID NO: 8. In another aspect of this embodiment, a polynucleotide molecule encodes a TeNT comprising a naturally occurring TeNT variant, such as, e.g., a TeNT isoform or a TeNT subtype. In another aspect of this embodiment, a polynucleotide molecule encodes a TeNT comprising a naturally occurring TeNT variant of SEQ ID NO: 8, such as, e.g., a TeNT isoform of SEQ ID NO: 8 or a TeNT subtype of SEQ ID NO: 8. In still another aspect of this embodiment, a polynucleotide molecule encodes a TeNT comprising a non-naturally occurring TeNT variant, such as, e.g., a conservative TeNT variant, a non-conservative TeNT variant or an active TeNT fragment, or any combination thereof. In still another aspect of this embodiment, a polynucleotide molecule encodes a TeNT comprising a non-naturally occurring TeNT variant of SEQ ID NO: 8, such as, e.g., a conservative TeNT variant of SEQ ID NO: 8, a non-conservative TeNT variant of SEQ ID NO: 8 or an active TeNT fragment of SEQ ID NO: 8, or any combination thereof. In yet another aspect of this embodiment, a TeNT comprising a TeNT enzymatic domain or an active fragment thereof, a TeNT translocation domain or active fragment thereof, a TeNT binding domain or active fragment thereof, and any combination thereof. In yet another aspect of this embodiment, a TeNT comprising a TeNT enzymatic domain of amino acids 1-441 from SEQ ID NO: 8 or active fragment thereof, a TeNT translocation domain of amino acids 442-870 from SEQ ID NO: 8 or active fragment thereof, a TeNT binding domain of amino acids 871-1315 from SEQ ID NO: 8 or active fragment thereof, and any combination thereof.

In other aspects of this embodiment, a polynucleotide molecule encodes a TeNT comprising a polypeptide having, e.g., at least 70% amino acid identity with SEQ ID NO: 8, at least 75% amino acid identity with the SEQ ID NO: 8, at least 80% amino acid identity with SEQ ID NO: 8, at least 85% amino acid identity with SEQ ID NO: 8, at least 90% amino acid identity with SEQ ID NO: 8 or at least 95% amino acid identity with SEQ ID NO: 8. In yet other aspects of this embodiment, a polynucleotide molecule encodes a TeNT comprising a polypeptide having, e.g., at most 70% amino acid identity with SEQ ID NO: 8, at most 75% amino acid identity with the SEQ ID NO: 8, at most 80% amino acid identity with SEQ ID NO: 8, at most 85% amino acid identity with SEQ ID NO: 8, at most 90% amino acid identity with SEQ ID NO: 8 or at most 95% amino acid identity with SEQ ID NO: 8.

In other aspects of this embodiment, a polynucleotide molecule encodes a TeNT comprising a polypeptide having, e.g., at most one, two, three, four, five, six, seven, eight, nine, 10, 20, 30, 40, 50, 100, 200 or 500 non-contiguous amino acid substitutions relative to SEQ ID NO: 8. In other aspects of this embodiment, a polynucleotide molecule encodes a TeNT comprising a polypeptide having, e.g., at least one, two, three, four, five, six, seven, eight, nine, 10, 20, 30, 40, 50, 100, 200 or 500 non-contiguous amino acid substitutions relative to SEQ ID NO: 8. In yet other aspects of this embodiment, a polynucleotide molecule encodes a TeNT comprising a polypeptide having, e.g., at most one, two, three, four, five, six, seven, eight, nine, 10, 20, 30, 40, 50, 100, 200 or 500 non-contiguous amino acid deletions relative to SEQ ID NO: 8. In other aspects of this embodiment, a polynucleotide molecule encodes a TeNT comprising a polypeptide having, e.g., at least one, two, three, four, five, six, seven, eight, nine, 10, 20, 30, 40, 50, 100, 200 or 500 non-contiguous amino acid deletions relative to SEQ ID NO: 8. In still other aspects of this embodiment, a polynucleotide molecule encodes a TeNT comprising a polypeptide having, e.g., at most one, two, three, four, five, six, seven, eight, nine, 10, 20, 30, 40, 50, 100, 200 or 500 non-contiguous amino acid additions relative to SEQ ID NO: 8. In other aspects of this embodiment, a polynucleotide molecule encodes a TeNT comprising a polypeptide having, e.g., at least one, two, three, four, five, six, seven, eight, nine, 10, 20, 30, 40, 50, 100, 200 or 500 non-contiguous amino acid additions relative to SEQ ID NO: 8.

In other aspects of this embodiment, a polynucleotide molecule encodes a TeNT comprising a polypeptide having, e.g., at most one, two, three, four, five, six, seven, eight, nine, 10, 20, 30, 40, 50, 100, 200 or 500 contiguous amino acid substitutions relative to SEQ ID NO: 8. In other aspects of this embodiment, a polynucleotide molecule encodes a TeNT comprising a polypeptide having, e.g., at least one, two, three, four, five, six, seven, eight, nine, 10, 20, 30, 40, 50, 100, 200 or 500 contiguous amino acid substitutions relative to SEQ ID NO: 8. In yet other aspects of this embodiment, a polynucleotide molecule encodes a TeNT comprising a polypeptide having, e.g., at most one, two, three, four, five, six, seven, eight, nine, 10, 20, 30, 40, 50, 100, 200 or 500 contiguous amino acid deletions relative to SEQ ID NO: 8. In other aspects of this embodiment, a polynucleotide molecule encodes a TeNT comprising a polypeptide having, e.g., at least one, two, three, four, five, six, seven, eight, nine, 10, 20, 30, 40, 50, 100, 200 or 500 contiguous amino acid deletions relative to SEQ ID NO: 8. In still other aspects of this embodiment, a polynucleotide molecule encodes a TeNT comprising a polypeptide having, e.g., at most one, two, three, four, five, six, seven, eight, nine, 10, 20, 30, 40, 50, 100, 200 or 500 contiguous amino acid additions relative to SEQ ID NO: 8. In other aspects of this embodiment, a polynucleotide molecule encodes a TeNT comprising a polypeptide having, e.g., at least one, two, three, four, five, six, seven, eight, nine, 10, 20, 30, 40, 50, 100, 200 or 500 contiguous amino acid additions relative to SEQ ID NO: 8.

In still another embodiment, a polynucleotide molecule encodes a PAR ligand domain comprising a naturally occurring PAR ligand domain variant, such as, e.g., a PAR ligand domain isoform or a PAR ligand domain subtype. In another embodiment, a polynucleotide molecule encodes a PAR ligand domain comprising a non-naturally occurring PAR ligand domain variant, such as, e.g., a conservative PAR ligand domain variant, a non-conservative PAR ligand domain variant or a PAR ligand domain peptidomimetic, or any combination thereof.

In still another embodiment, a polynucleotide molecule encodes a PAR ligand domain comprising a PAR1 ligand domain. In an aspect of this embodiment, a polynucleotide molecule encodes a PAR1 ligand domain comprising SEQ ID NO: 13. In another aspect of this embodiment, a polynucleotide molecule encodes a PAR1 ligand domain comprising a naturally occurring PAR1 ligand domain variant, such as, e.g., a PAR1 ligand domain isoform or a PAR1 ligand domain subtype. In another aspect of this embodiment, a polynucleotide molecule encodes a PAR1 ligand domain comprising a naturally occurring PAR1 ligand domain variant of SEQ ID NO: 13, such as, e.g., a PAR1 ligand domain isoform of SEQ ID NO: 13 or a PAR1 ligand domain subtype of SEQ ID NO: 13. In still another aspect of this embodiment, a polynucleotide molecule encodes a PAR1 ligand domain comprising a non-naturally occurring PAR1 ligand domain variant, such as, e.g., a conservative PAR1 ligand domain variant, a non-conservative PAR1 ligand domain variant or a PAR1 ligand domain peptidomimetic, or any combination thereof. In still another aspect of this embodiment, a polynucleotide molecule encodes a PAR1 ligand domain comprising a non-naturally occurring PAR1 ligand domain variant of SEQ ID NO: 13, such as, e.g., a conservative PAR1 ligand domain variant of SEQ ID NO: 13, a non-conservative PAR1 ligand domain variant of SEQ ID NO: 13 or a PAR1 ligand domain peptidomimetic of SEQ ID NO: 13, or any combination thereof. In other aspects of this embodiment, a polynucleotide molecule encodes a PAR1 ligand domain comprising SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22 or SEQ ID NO: 23.

In other aspects of this embodiment, a polynucleotide molecule encodes a PAR1 ligand domain comprising a polypeptide having, e.g., at least 50% amino acid identity with SEQ ID NO: 13, at least 67% amino acid identity with the SEQ ID NO: 13, or at least 83% amino acid identity with SEQ ID NO: 13. In still other aspects of this embodiment, a polynucleotide molecule encodes a PAR1 ligand domain comprising a polypeptide having, e.g., at most 50% amino acid identity with SEQ ID NO: 13, at most 67% amino acid identity with the SEQ ID NO: 13, at most 83% amino acid identity with SEQ ID NO: 13.

In other aspects of this embodiment, a polynucleotide molecule encodes a PAR1 ligand domain comprising a polypeptide having, e.g., at most one, two, three or four non-contiguous amino acid substitutions relative to SEQ ID NO: 13. In still other aspects of this embodiment, a polynucleotide molecule encodes a PAR1 ligand domain comprising a polypeptide having, e.g., at least one, two, three or four non-contiguous amino acid substitutions relative to SEQ ID NO: 13. In yet other aspects of this embodiment, a polynucleotide molecule encodes a PAR1 ligand domain comprising a polypeptide having, e.g., at most one, two, three, four, five, six, seven, eight, nine or ten non-contiguous amino acid additions relative to SEQ ID NO: 13. In yet other aspects of this embodiment, a polynucleotide molecule encodes a PAR1 ligand domain comprising a polypeptide having, e.g., at least one, two, three, four, five, six, seven, eight, nine or ten non-contiguous amino acid additions relative to SEQ ID NO: 13. In still other aspects of this embodiment, a polynucleotide molecule encodes a PAR1 ligand domain comprising a polypeptide having, e.g., at most one, two or three non-contiguous amino acid deletions relative to SEQ ID NO: 13. In still other aspects of this embodiment, a polynucleotide molecule encodes a PAR1 ligand domain comprising a polypeptide having, e.g., at least one, two or three non-contiguous amino acid deletions relative to SEQ ID NO: 13.

In other aspects of this embodiment, a polynucleotide molecule encodes a PAR1 ligand domain comprising a polypeptide having, e.g., at most two, three or four contiguous amino acid substitutions relative to SEQ ID NO: 13. In still other aspects of this embodiment, a polynucleotide molecule encodes a PAR1 ligand domain comprising a polypeptide having, e.g., at least two, three or four contiguous amino acid substitutions relative to SEQ ID NO: 13. In yet other aspects of this embodiment, a polynucleotide molecule encodes a PAR1 ligand domain comprising a polypeptide having, e.g., at most two, three, four, five, six, seven, eight, nine or ten contiguous amino acid additions relative to SEQ ID NO: 13. In yet other aspects of this embodiment, a polynucleotide molecule encodes a PAR1 ligand domain comprising a polypeptide having, e.g., at least two, three, four, five, six, seven, eight, nine or ten contiguous amino acid additions relative to SEQ ID NO: 13. In still other aspects of this embodiment, a polynucleotide molecule encodes a PAR1 ligand domain comprising a polypeptide having, e.g., at most two or three contiguous amino acid deletions relative to SEQ ID NO: 13. In still other aspects of this embodiment, a polynucleotide molecule encodes a PAR1 ligand domain comprising a polypeptide having, e.g., at least two or three contiguous amino acid deletions relative to SEQ ID NO: 13.

In still another embodiment, a polynucleotide molecule encodes a PAR ligand domain comprising a PAR2 ligand domain. In an aspect of this embodiment, a polynucleotide molecule encodes a PAR2 ligand domain comprising SEQ ID NO: 24. In another aspect of this embodiment, a polynucleotide molecule encodes a PAR2 ligand domain comprising a naturally occurring PAR2 ligand domain variant, such as, e.g., a PAR2 ligand domain isoform or a PAR2 ligand domain subtype. In another aspect of this embodiment, a polynucleotide molecule encodes a PAR2 ligand domain comprising a naturally occurring PAR2 ligand domain variant of SEQ ID NO: 24, such as, e.g., a PAR2 ligand domain isoform of SEQ ID NO: 24 or a PAR2 ligand domain subtype of SEQ ID NO: 24. In still another aspect of this embodiment, a polynucleotide molecule encodes a PAR2 ligand domain comprising a non-naturally occurring PAR2 ligand domain variant, such as, e.g., a conservative PAR2 ligand domain variant, a non-conservative PAR2 ligand domain variant or a PAR2 ligand domain peptidomimetic, or any combination thereof. In still another aspect of this embodiment, a polynucleotide molecule encodes a PAR2 ligand domain comprising a non-naturally occurring PAR2 ligand domain variant of SEQ ID NO: 24, such as, e.g., a conservative PAR2 ligand domain variant of SEQ ID NO: 24, a non-conservative PAR2 ligand domain variant of SEQ ID NO: 24 or a PAR2 ligand domain peptidomimetic of SEQ ID NO: 24, or any combination thereof. In other aspects of this embodiment, a polynucleotide molecule encodes a PAR2 ligand domain comprising SEQ ID NO: 24 or SEQ ID NO: 25.

In other aspects of this embodiment, a polynucleotide molecule encodes a PAR2 ligand domain comprising a polypeptide having, e.g., at least 50% amino acid identity with SEQ ID NO: 24, at least 67% amino acid identity with the SEQ ID NO: 24, or at least 83% amino acid identity with SEQ ID NO: 24. In still other aspects of this embodiment, a polynucleotide molecule encodes a PAR2 ligand domain comprising a polypeptide having, e.g., at most 50% amino acid identity with SEQ ID NO: 24, at most 67% amino acid identity with the SEQ ID NO: 24, at most 83% amino acid identity with SEQ ID NO: 24.

In other aspects of this embodiment, a polynucleotide molecule encodes a PAR2 ligand domain comprising a polypeptide having, e.g., at most one, two, three or four non-contiguous amino acid substitutions relative to SEQ ID NO: 24. In still other aspects of this embodiment, a polynucleotide molecule encodes a PAR2 ligand domain comprising a polypeptide having, e.g., at least one, two, three or four non-contiguous amino acid substitutions relative to SEQ ID NO: 24. In yet other aspects of this embodiment, a polynucleotide molecule encodes a PAR2 ligand domain comprising a polypeptide having, e.g., at most one, two, three, four, five, six, seven, eight, nine or ten non-contiguous amino acid additions relative to SEQ ID NO: 24. In yet other aspects of this embodiment, a polynucleotide molecule encodes a PAR2 ligand domain comprising a polypeptide having, e.g., at least one, two, three, four, five, six, seven, eight, nine or ten non-contiguous amino acid additions relative to SEQ ID NO: 24. In still other aspects of this embodiment, a polynucleotide molecule encodes a PAR2 ligand domain comprising a polypeptide having, e.g., at most one, two or three non-contiguous amino acid deletions relative to SEQ ID NO: 24. In still other aspects of this embodiment, a polynucleotide molecule encodes a PAR2 ligand domain comprising a polypeptide having, e.g., at least one, two or three non-contiguous amino acid deletions relative to SEQ ID NO: 24.

In other aspects of this embodiment, a polynucleotide molecule encodes a PAR2 ligand domain comprising a polypeptide having, e.g., at most two, three or four contiguous amino acid substitutions relative to SEQ ID NO: 24. In still other aspects of this embodiment, a polynucleotide molecule encodes a PAR2 ligand domain comprising a polypeptide having, e.g., at least two, three or four contiguous amino acid substitutions relative to SEQ ID NO: 24. In yet other aspects of this embodiment, a polynucleotide molecule encodes a PAR2 ligand domain comprising a polypeptide having, e.g., at most two, three, four, five, six, seven, eight, nine or ten contiguous amino acid additions relative to SEQ ID NO: 24. In yet other aspects of this embodiment, a polynucleotide molecule encodes a PAR2 ligand domain comprising a polypeptide having, e.g., at least two, three, four, five, six, seven, eight, nine or ten contiguous amino acid additions relative to SEQ ID NO: 24. In still other aspects of this embodiment, a polynucleotide molecule encodes a PAR2 ligand domain comprising a polypeptide having, e.g., at most two or three contiguous amino acid deletions relative to SEQ ID NO: 24. In still other aspects of this embodiment, a polynucleotide molecule encodes a PAR2 ligand domain comprising a polypeptide having, e.g., at least two or three contiguous amino acid deletions relative to SEQ ID NO: 24.

In still another embodiment, a polynucleotide molecule encodes a PAR ligand domain comprising a PAR3 ligand domain. In an aspect of this embodiment, a polynucleotide molecule encodes a PAR3 ligand domain comprising SEQ ID NO: 26. In another aspect of this embodiment, a polynucleotide molecule encodes a PAR3 ligand domain comprising a naturally occurring PAR3 ligand domain variant, such as, e.g., a PAR3 ligand domain isoform or a PAR3 ligand domain subtype. In another aspect of this embodiment, a polynucleotide molecule encodes a PAR3 ligand domain comprising a naturally occurring PAR3 ligand domain variant of SEQ ID NO: 26, such as, e.g., a PAR3 ligand domain isoform of SEQ ID NO: 26 or a PAR3 ligand domain subtype of SEQ ID NO: 26. In still another aspect of this embodiment, a polynucleotide molecule encodes a PAR3 ligand domain comprising a non-naturally occurring PAR3 ligand domain variant, such as, e.g., a conservative PAR3 ligand domain variant, a non-conservative PAR3 ligand domain variant or a PAR3 ligand domain peptidomimetic, or any combination thereof. In still another aspect of this embodiment, a polynucleotide molecule encodes a PAR3 ligand domain comprising a non-naturally occurring PAR3 ligand domain variant of SEQ ID NO: 26, such as, e.g., a conservative PAR3 ligand domain variant of SEQ ID NO: 26, a non-conservative PAR3 ligand domain variant of SEQ ID NO: 26 or a PAR3 ligand domain peptidomimetic of SEQ ID NO: 26, or any combination thereof. In other aspects of this embodiment, a polynucleotide molecule encodes a PAR3 ligand domain comprising SEQ ID NO: 26 or SEQ ID NO: 27.

In other aspects of this embodiment, a polynucleotide molecule encodes a PAR3 ligand domain comprising a polypeptide having, e.g., at least 50% amino acid identity with SEQ ID NO: 26, at least 67% amino acid identity with the SEQ ID NO: 26, or at least 83% amino acid identity with SEQ ID NO: 26. In still other aspects of this embodiment, a polynucleotide molecule encodes a PAR3 ligand domain comprising a polypeptide having, e.g., at most 50% amino acid identity with SEQ ID NO: 26, at most 67% amino acid identity with the SEQ ID NO: 26, at most 83% amino acid identity with SEQ ID NO: 26.

In other aspects of this embodiment, a polynucleotide molecule encodes a PAR3 ligand domain comprising a polypeptide having, e.g., at most one, two, three or four non-contiguous amino acid substitutions relative to SEQ ID NO: 26. In still other aspects of this embodiment, a polynucleotide molecule encodes a PAR3 ligand domain comprising a polypeptide having, e.g., at least one, two, three or four non-contiguous amino acid substitutions relative to SEQ ID NO: 26. In yet other aspects of this embodiment, a polynucleotide molecule encodes a PAR3 ligand domain comprising a polypeptide having, e.g., at most one, two, three, four, five, six, seven, eight, nine or ten non-contiguous amino acid additions relative to SEQ ID NO: 26. In yet other aspects of this embodiment, a polynucleotide molecule encodes a PAR3 ligand domain comprising a polypeptide having, e.g., at least one, two, three, four, five, six, seven, eight, nine or ten non-contiguous amino acid additions relative to SEQ ID NO: 26. In still other aspects of this embodiment, a polynucleotide molecule encodes a PAR3 ligand domain comprising a polypeptide having, e.g., at most one, two or three non-contiguous amino acid deletions relative to SEQ ID NO: 26. In still other aspects of this embodiment, a polynucleotide molecule encodes a PAR3 ligand domain comprising a polypeptide having, e.g., at least one, two or three non-contiguous amino acid deletions relative to SEQ ID NO: 26.

In other aspects of this embodiment, a polynucleotide molecule encodes a PAR3 ligand domain comprising a polypeptide having, e.g., at most two, three or four contiguous amino acid substitutions relative to SEQ ID NO: 26. In still other aspects of this embodiment, a polynucleotide molecule encodes a PAR3 ligand domain comprising a polypeptide having, e.g., at least two, three or four contiguous amino acid substitutions relative to SEQ ID NO: 26. In yet other aspects of this embodiment, a polynucleotide molecule encodes a PAR3 ligand domain comprising a polypeptide having, e.g., at most two, three, four, five, six, seven, eight, nine or ten contiguous amino acid additions relative to SEQ ID NO: 26. In yet other aspects of this embodiment, a polynucleotide molecule encodes a PAR3 ligand domain comprising a polypeptide having, e.g., at least two, three, four, five, six, seven, eight, nine or ten contiguous amino acid additions relative to SEQ ID NO: 26. In still other aspects of this embodiment, a polynucleotide molecule encodes a PAR3 ligand domain comprising a polypeptide having, e.g., at most two or three contiguous amino acid deletions relative to SEQ ID NO: 26. In still other aspects of this embodiment, a polynucleotide molecule encodes a PAR3 ligand domain comprising a polypeptide having, e.g., at least two or three contiguous amino acid deletions relative to SEQ ID NO: 26.

In still another embodiment, a polynucleotide molecule encodes a PAR ligand domain comprising a PAR4 ligand domain. In an aspect of this embodiment, a polynucleotide molecule encodes a PAR4 ligand domain comprising SEQ ID NO: 28. In another aspect of this embodiment, a polynucleotide molecule encodes a PAR4 ligand domain comprising a naturally occurring PAR4 ligand domain variant, such as, e.g., a PAR4 ligand domain isoform or a PAR4 ligand domain subtype. In another aspect of this embodiment, a polynucleotide molecule encodes a PAR4 ligand domain comprising a naturally occurring PAR4 ligand domain variant of SEQ ID NO: 28, such as, e.g., a PAR4 ligand domain isoform of SEQ ID NO: 28 or a PAR4 ligand domain subtype of SEQ ID NO: 28. In still another aspect of this embodiment, a polynucleotide molecule encodes a PAR4 ligand domain comprising a non-naturally occurring PAR4 ligand domain variant, such as, e.g., a conservative PAR4 ligand domain variant, a non-conservative PAR4 ligand domain variant or a PAR4 ligand domain peptidomimetic, or any combination thereof. In still another aspect of this embodiment, a polynucleotide molecule encodes a PAR4 ligand domain comprising a non-naturally occurring PAR4 ligand domain variant of SEQ ID NO: 28, such as, e.g., a conservative PAR4 ligand domain variant of SEQ ID NO: 28, a non-conservative PAR4 ligand domain variant of SEQ ID NO: 28 or a PAR4 ligand domain peptidomimetic of SEQ ID NO: 28, or any combination thereof. In other aspects of this embodiment, a polynucleotide molecule encodes a PAR4 ligand domain comprising SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46 or SEQ ID NO: 47.

In other aspects of this embodiment, a polynucleotide molecule encodes a PAR4 ligand domain comprising a polypeptide having, e.g., at least 50% amino acid identity with SEQ ID NO: 28, at least 67% amino acid identity with the SEQ ID NO: 28, or at least 83% amino acid identity with SEQ ID NO: 28. In still other aspects of this embodiment, a polynucleotide molecule encodes a PAR4 ligand domain comprising a polypeptide having, e.g., at most 50% amino acid identity with SEQ ID NO: 28, at most 67% amino acid identity with the SEQ ID NO: 28, at most 83% amino acid identity with SEQ ID NO: 28.

In other aspects of this embodiment, a polynucleotide molecule encodes a PAR4 ligand domain comprising a polypeptide having, e.g., at most one, two, three or four non-contiguous amino acid substitutions relative to SEQ ID NO: 28. In still other aspects of this embodiment, a polynucleotide molecule encodes a PAR4 ligand domain comprising a polypeptide having, e.g., at least one, two, three or four non-contiguous amino acid substitutions relative to SEQ ID NO: 28. In yet other aspects of this embodiment, a polynucleotide molecule encodes a PAR4 ligand domain comprising a polypeptide having, e.g., at most one, two, three, four, five, six, seven, eight, nine or ten non-contiguous amino acid additions relative to SEQ ID NO: 28. In yet other aspects of this embodiment, a polynucleotide molecule encodes a PAR4 ligand domain comprising a polypeptide having, e.g., at least one, two, three, four, five, six, seven, eight, nine or ten non-contiguous amino acid additions relative to SEQ ID NO: 28. In still other aspects of this embodiment, a polynucleotide molecule encodes a PAR4 ligand domain comprising a polypeptide having, e.g., at most one, two or three non-contiguous amino acid deletions relative to SEQ ID NO: 28. In still other aspects of this embodiment, a polynucleotide molecule encodes a PAR4 ligand domain comprising a polypeptide having, e.g., at least one, two or three non-contiguous amino acid deletions relative to SEQ ID NO: 28.

In other aspects of this embodiment, a polynucleotide molecule encodes a PAR4 ligand domain comprising a polypeptide having, e.g., at most two, three or four contiguous amino acid substitutions relative to SEQ ID NO: 28. In still other aspects of this embodiment, a polynucleotide molecule encodes a PAR4 ligand domain comprising a polypeptide having, e.g., at least two, three or four contiguous amino acid substitutions relative to SEQ ID NO: 28. In yet other aspects of this embodiment, a polynucleotide molecule encodes a PAR4 ligand domain comprising a polypeptide having, e.g., at most two, three, four, five, six, seven, eight, nine or ten contiguous amino acid additions relative to SEQ ID NO: 28. In yet other aspects of this embodiment, a polynucleotide molecule encodes a PAR4 ligand domain comprising a polypeptide having, e.g., at least two, three, four, five, six, seven, eight, nine or ten contiguous amino acid additions relative to SEQ ID NO: 28. In still other aspects of this embodiment, a polynucleotide molecule encodes a PAR4 ligand domain comprising a polypeptide having, e.g., at most two or three contiguous amino acid deletions relative to SEQ ID NO: 28. In still other aspects of this embodiment, a polynucleotide molecule encodes a PAR4 ligand domain comprising a polypeptide having, e.g., at least two or three contiguous amino acid deletions relative to SEQ ID NO: 28.

In yet another embodiment, a polynucleotide molecule encoding a modified Clostridial toxin disclosed in the present specification can further comprise a polynucleotide molecule encoding a flexible region comprising a flexible spacer. In another embodiment, a polynucleotide molecule encoding a modified Clostridial toxin disclosed in the present specification can further comprise a polynucleotide molecule encoding a flexible region comprising a plurality of flexible spacers in tandem. In aspects of this embodiment, a polynucleotide molecule encoding a flexible region can comprise in tandem, e.g., at least 1 G-spacer, at least 2 G-spacers, at least 3 G-spacers, at least 4 G-spacers or at least 5 G-spacers. In other aspects of this embodiment, a polynucleotide molecule encoding a flexible region can comprise in tandem, e.g., at most 1 G-spacer, at most 2 G-spacers, at most 3 G-spacers, at most 4 G-spacers or at most 5 G-spacers. In still other aspects of this embodiment, a polynucleotide molecule encoding a flexible region can comprise in tandem, e.g., at least 1 A-spacer, at least 2 A-spacers, at least 3 A-spacers, at least 4 A-spacers or at least 5 A-spacers. In still other aspects of this embodiment, a polynucleotide molecule encoding a flexible region can comprise in tandem, e.g., at most 1 A-spacer, at most 2 A-spacers, at most 3 A-spacers, at most 4 A-spacers or at most 5 A-spacers. In another aspect of this embodiment, a polynucleotide molecule encoding a modified Clostridial toxin can comprise a polynucleotide molecule encoding a flexible region comprising one or more copies of the same flexible spacers, one or more copies of different flexible-spacers region, or any combination thereof.

In yet another embodiment, a polynucleotide molecule encoding a modified Clostridial toxin disclosed in the present specification can further comprises a polynucleotide molecule encoding an epitope-binding region. In another embodiment, a polynucleotide molecule encoding a modified Clostridial toxin disclosed in the present specification can further comprises a polynucleotide molecule encoding a plurality of epitope-binding regions. In aspects of this embodiment, a polynucleotide molecule encoding a modified Clostridial toxin can comprise, e.g., at least 1 polynucleotide molecule encoding an epitope-binding region, at least 2 polynucleotide molecules encoding epitope-binding regions, at least 3 polynucleotide molecules encoding epitope-binding regions, at least 4 polynucleotide molecules encoding epitope-binding regions or at least 5 polynucleotide molecules encoding epitope-binding regions. In other aspects of this embodiment, a polynucleotide molecule encoding a modified Clostridial toxin can comprise, e.g., at most 1 polynucleotide molecule encoding an epitope-binding region, at most 2 polynucleotide molecules encoding epitope-binding regions, at most 3 polynucleotide molecules encoding epitope-binding regions, at most 4 polynucleotide molecules encoding epitope-binding regions or at most 5 polynucleotide molecules encoding epitope-binding regions. In another aspect of this embodiment, a polynucleotide molecule encoding a modified Clostridial toxin can comprise one or more copies of the same polynucleotide molecules encoding epitope-binding region, one or more copies of different polynucleotide molecules encoding epitope-binding region, or any combination thereof. The location of a polynucleotide molecule encoding an epitope-binding region can be in various positions, including, without limitation, at the amino terminus of a modified Clostridial toxin, within a modified Clostridial toxin, or at the carboxyl terminus of a modified Clostridial toxin.

In yet another embodiment, polynucleotide molecules encoding a modified Clostridial toxin disclosed in the present specification can further comprise a polynucleotide molecule encoding an exogenous protease cleavage site. In another embodiment, a polynucleotide molecule encoding a modified Clostridial toxin disclosed in the present specification can further comprises a plurality of polynucleotide molecules encoding exogenous protease cleavage sites. In aspects of this embodiment, a polynucleotide molecule encoding a modified Clostridial toxin can comprise, e.g., at least 1 polynucleotide molecule encoding an exogenous protease cleavage site, at least 2 polynucleotide molecules encoding exogenous protease cleavage sites, at least 3 polynucleotide molecules encoding exogenous protease cleavage sites, at least 4 polynucleotide molecules encoding exogenous protease cleavage sites or at least 5 polynucleotide molecules encoding exogenous protease cleavage sites. In other aspects of this embodiment, polynucleotide molecules encoding a modified Clostridial toxin can comprise, e.g., at most 1 polynucleotide molecule encoding an exogenous protease cleavage site, at most 2 polynucleotide molecules encoding exogenous protease cleavage sites, at most 3 polynucleotide molecules encoding exogenous protease cleavage sites, at most 4 polynucleotide molecules encoding exogenous protease cleavage sites or at most 5 polynucleotide molecules encoding exogenous protease cleavage sites. In another aspect of this embodiment, a polynucleotide molecule encoding a modified Clostridial toxin can comprise one or more copies of the same exogenous protease cleavage site, one or more copies of different exogenous protease cleavage site, or any combination thereof.

In yet another embodiment, a polynucleotide molecule encoding an exogenous protease cleavage site is located between a polynucleotide molecule encoding an epitope-binding peptide and a polynucleotide molecule encoding a modified Clostridial toxin. In other aspects of this embodiment, a polynucleotide molecule encoding a bovine enterokinase cleavage site is located between a polynucleotide molecule encoding an epitope-binding region and a polynucleotide molecule encoding a modified Clostridial toxin, a polynucleotide molecule encoding a Tobacco Etch Virus protease cleavage site is located between a polynucleotide molecule encoding an epitope-binding region and a polynucleotide molecule encoding a modified Clostridial toxin, a polynucleotide molecule encoding a Human Rhinovirus 3C protease cleavage site is located between a polynucleotide molecule encoding an epitope-binding region and a polynucleotide molecule encoding a modified Clostridial toxin, a polynucleotide molecule encoding a SUMO/ULP-1 protease cleavage site is located between a polynucleotide molecule encoding an epitope-binding region and a polynucleotide molecule encoding a modified Clostridial toxin, a polynucleotide molecule encoding a Thrombin protease cleavage site is located between a polynucleotide molecule encoding an epitope-binding region and a polynucleotide molecule encoding a modified Clostridial toxin, or a polynucleotide molecule encoding a Coagulation Factor Xa protease cleavage site is located between a polynucleotide molecule encoding an epitope-binding region and a polynucleotide molecule encoding a modified Clostridial toxin. In other aspects of the embodiment, a polynucleotide molecule encoding the bovine enterokinase protease cleavage site of SEQ ID NO: 50 is located between a polynucleotide molecule encoding an epitope-binding region and a polynucleotide molecule encoding a modified Clostridial toxin. In other aspects of the embodiment, a polynucleotide molecule encoding the Tobacco Etch Virus protease cleavage site of SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59 or SEQ ID NO: 60 is located between a polynucleotide molecule encoding an epitope-binding region and a polynucleotide molecule encoding a modified Clostridial toxin. In still other aspects of the embodiment, a polynucleotide molecule encoding the Human Rhinovirus 3C protease cleavage site of SEQ ID NO: 61, SEQ ID NO: 62, SEQ ID NO: 63, SEQ ID NO: 64, SEQ ID NO: 65 or SEQ ID NO: 66 is located between a polynucleotide molecule encoding an epitope-binding region and a polynucleotide molecule encoding a modified Clostridial toxin. In yet other aspects of the embodiment, a polynucleotide molecule encoding the SUMO/ULP-1 protease cleavage site of SEQ ID NO: 67 is located between a polynucleotide molecule encoding an epitope-binding region and a polynucleotide molecule encoding a modified Clostridial toxin. In further other aspects of the embodiment, a polynucleotide molecule encoding the Thrombin protease cleavage site of SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81 or SEQ ID NO: 82 is located between a polynucleotide molecule encoding an epitope-binding region and a polynucleotide molecule encoding a modified Clostridial toxin. In other aspects of the embodiment, a polynucleotide molecule encoding the Coagulation Factor Xa protease cleavage site of SEQ ID NO: 83 or SEQ ID NO: 84 is located between a polynucleotide molecule encoding an epitope-binding region and a polynucleotide molecule encoding a modified Clostridial toxin.

In yet another embodiment, a polynucleotide molecule encoding an exogenous protease cleavage site is located within a polynucleotide molecule encoding the di-chain loop of a modified Clostridial toxin. In aspects of this embodiment, a polynucleotide molecule encoding a bovine enterokinase cleavage site is located within a polynucleotide molecule encoding the di-chain loop of a modified Clostridial toxin, a polynucleotide molecule encoding a Tobacco Etch Virus protease cleavage site is located within a polynucleotide molecule encoding the di-chain loop of a modified Clostridial toxin, a polynucleotide molecule encoding a Human Rhinovirus 3C protease cleavage site is located within a polynucleotide molecule encoding the di-chain loop of a modified Clostridial toxin, a polynucleotide molecule encoding a SUMO/ULP-1 protease cleavage site is located within a polynucleotide molecule encoding the di-chain loop of a modified Clostridial toxin, a polynucleotide molecule encoding a Thrombin protease cleavage site is located within a polynucleotide molecule encoding the di-chain loop of a modified Clostridial toxin, or a polynucleotide molecule encoding a Coagulation Factor Xa protease cleavage site is located within a polynucleotide molecule encoding the di-chain loop of a modified Clostridial toxin. In other aspects of the embodiment, a polynucleotide molecule encoding the bovine enterokinase protease cleavage site of SEQ ID NO: 50 is located within a polynucleotide molecule encoding the di-chain loop of a modified Clostridial toxin. In other aspects of the embodiment, a polynucleotide molecule encoding the Tobacco Etch Virus protease cleavage site of SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59 or SEQ ID NO: 60 is located within a polynucleotide molecule encoding the di-chain loop of a modified Clostridial toxin. In still other aspects of the embodiment, a polynucleotide molecule encoding the Human Rhinovirus 3C protease cleavage site of SEQ ID NO: 61, SEQ ID NO: 62, SEQ ID NO: 63, SEQ ID NO: 64, SEQ ID NO: 65 or SEQ ID NO: 66 is located within a polynucleotide molecule encoding the di-chain loop of a modified Clostridial toxin. In yet other aspects of the embodiment, a polynucleotide molecule encoding the SUMO/ULP-1 protease cleavage site of SEQ ID NO: 67 is located within a polynucleotide molecule encoding the di-chain loop of a modified Clostridial toxin. In further other aspects of the embodiment, a polynucleotide molecule encoding the Thrombin protease cleavage site of SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81 or SEQ ID NO: 82 is located within a polynucleotide molecule encoding the di-chain loop of a modified Clostridial toxin. In other aspects of the embodiment, a polynucleotide molecule encoding the Coagulation Factor Xa protease cleavage site of SEQ ID NO: 83 or SEQ ID NO: 84 is located within a polynucleotide molecule encoding the di-chain loop of a modified Clostridial toxin.

Another aspect of the present invention provides a method of producing a modified Clostridial toxin comprising a PAR ligand domain; a Clostridial toxin enzymatic domain; a Clostridial toxin translocation domain; and a Clostridial toxin binding domain, such method comprising the step of expressing a polynucleotide molecule encoding a modified Clostridial toxin in a cell. Another aspect of the present invention provides a method of producing a modified Clostridial toxin comprising a PAR ligand domain; a Clostridial toxin enzymatic domain; a Clostridial toxin translocation domain; and a Clostridial toxin binding domain, such method comprising the steps of introducing an expression construct comprising a polynucleotide molecule encoding a modified Clostridial toxin into a cell and expressing the expression construct in the cell.

The methods disclosed in the present specification include, in part, a Clostridial toxin. It is envisioned that any and all Clostridial toxins disclosed in the present specification can be produced using the methods disclosed in the present specification. Thus, aspects of this embodiment include producing, without limitation, naturally occurring Clostridial toxins, naturally occurring Clostridial toxins variants, such as, e.g., Clostridial toxins isoforms and Clostridial toxins subtypes, non-naturally occurring Clostridial toxins variants, such as, e.g., conservative Clostridial toxins variants, non-conservative Clostridial toxins variants and Clostridial toxins fragments thereof, or any combination thereof.

The methods disclosed in the present specification include, in part, a PAR binding domain. It is envisioned that any and all PAR binding domains disclosed in the present specification can be produced using the methods disclosed in the present specification. Thus, aspects of this embodiment include producing, without limitation, naturally occurring PAR binding domains, naturally occurring PAR binding domain variants, such as, e.g., PAR binding domain isoforms and PAR binding domain subtypes, non-naturally occurring PAR binding domain variants, such as, e.g., conservative PAR binding domain variants, non-conservative PAR binding domain variants and PAR binding domain fragments thereof, or any combination thereof.

The methods disclosed in the present specification include, in part, a polynucleotide molecule. It is envisioned that any and all polynucleotide molecules disclosed in the present specification can be used. Thus, aspects of this embodiment include, without limitation, polynucleotide molecules encoding naturally occurring Clostridial toxins; polynucleotide molecules encoding naturally occurring Clostridial toxins variants, such as, e.g., Clostridial toxins isoforms and Clostridial toxins subtypes; polynucleotide molecules encoding non-naturally occurring Clostridial toxins variants, such as, e.g., conservative Clostridial toxins variants, non-conservative Clostridial toxins variants and Clostridial toxins fragments thereof, or any combination thereof.

The methods disclosed in the present specification include, in part, an expression construct. An expression construct comprises a polynucleotide molecule disclosed in the present specification operably-linked to an expression vector useful for expressing the polynucleotide molecule in a cell or cell-free extract. A wide variety of expression vectors can be employed for expressing a polynucleotide molecule encoding a modified Clostridial toxin, including, without limitation, a viral expression vector; a prokaryotic expression vector; eukaryotic expression vectors, such as, e.g., a yeast expression vector, an insect expression vector and a mammalian expression vector; and a cell-free extract expression vector. It is further understood that expression vectors useful to practice aspects of these methods may include those which express a modified Clostridial toxin under control of a constitutive, tissue-specific, cell-specific or inducible promoter element, enhancer element or both. Non-limiting examples of expression vectors, along with well-established reagents and conditions for making and using an expression construct from such expression vectors are readily available from commercial vendors that include, without limitation, BD Biosciences-Clontech, Palo Alto, Calif.; BD Biosciences Pharmingen, San Diego, Calif.; Invitrogen, Inc, Carlsbad, Calif.; EMD Biosciences-Novagen, Madison, Wis.; QIAGEN, Inc., Valencia, Calif.; and Stratagene, La Jolla, Calif. The selection, making and use of an appropriate expression vector are routine procedures well within the scope of one skilled in the art and from the teachings herein.

Thus, aspects of this embodiment include, without limitation, a viral expression vector operably-linked to a polynucleotide molecule encoding a modified Clostridial toxin; a prokaryotic expression vector operably-linked to a polynucleotide molecule encoding a modified Clostridial toxin; a yeast expression vector operably-linked to a polynucleotide molecule encoding a modified Clostridial toxin; an insect expression vector operably-linked to a polynucleotide molecule encoding a modified Clostridial toxin; and a mammalian expression vector operably-linked to a polynucleotide molecule encoding a modified Clostridial toxin. Other aspects of this embodiment include, without limitation, expression constructs suitable for expressing a modified Clostridial toxin disclosed in the present specification using a cell-free extract comprising a cell-free extract expression vector operably linked to a polynucleotide molecule encoding a modified Clostridial toxin. Other aspects of this embodiment include, without limitation, expression constructs comprising polynucleotide molecules comprising any one of SEQ ID NO: 109 through SEQ ID NO: 132 and SEQ ID NO: 136 through SEQ ID NO: 159. Other aspects of this embodiment include, without limitation, expression constructs comprising polynucleotide molecules encoding a modified Clostridial toxin comprising any one of SEQ ID NO: 85 through SEQ ID NO: 108.

The methods disclosed in the present specification include, in part, a cell. It is envisioned that any and all cells can be used. Thus, aspects of this embodiment include, without limitation, prokaryotic cells including, without limitation, strains of aerobic, microaerophilic, capnophilic, facultative, anaerobic, gram-negative and gram-positive bacterial cells such as those derived from, e.g., *Escherichia coli, Bacillus subtilis, Bacillus licheniformis, Bacteroides fragilis, Clostridia perfringens, Clostridia difficile, Caulobacter crescentus, Lactococcus lactis, Methylobacterium extorquens, Neisseria meningirulls, Neisseria meningitidis, Pseudomonas fluorescens* and *Salmonella typhimurium*; and eukaryotic cells including, without limitation, yeast strains, such as, e.g., those derived from *Pichia pastoris, Pichia methanolica, Pichia angusta, Schizosaccharomyces pombe, Saccharomyces cerevisiae* and *Yarrowia lipolytica*; insect cells and cell lines derived from insects, such as, e.g., those derived from *Spodoptera frugiperda, Trichoplusia ni, Drosophila melanogaster* and *Manduca sexta*; and mammalian cells and cell lines derived from mammalian cells, such as, e.g., those derived from mouse, rat, hamster, porcine, bovine, equine, primate and human. Cell lines may be obtained from the American Type Culture Collection (2004), at URL address www.atcc.org; European Collection of Cell Cultures (2204), at URL address www.ecacc.org.uk; and the German Collection of Microorganisms and Cell Cultures (2004), at URL address www.dsmz.de. Non-limiting examples of specific protocols for selecting, making and using an appropriate cell line are described in e.g., INSECT CELL CULTURE ENGINEERING (Mattheus F. A. Goosen et al. eds., Marcel Dekker, 1993); INSECT CELL CULTURES: FUNDAMENTAL AND APPLIED ASPECTS (J. M. Vlak et al. eds., Kluwer Academic Publishers, 1996); Maureen A. Harrison & Ian F. Rae, GENERAL TECHNIQUES OF CELL CULTURE (Cambridge University Press, 1997); CELL AND TISSUE CULTURE: LABORATORY PROCEDURES (Alan Doyle et al eds., John Wiley and Sons, 1998); R. Ian Freshney, CULTURE OF ANIMAL CELLS: A MANUAL OF BASIC TECHNIQUE (Wiley-Liss, $4^{th}$ ed. 2000); ANIMAL CELL CULTURE: A PRACTICAL APPROACH (John R. W. Masters ed., Oxford University Press, $3^{rd}$ ed. 2000); MOLECULAR CLONING A LABORATORY MANUAL, supra, (2001); BASIC CELL CULTURE: A PRACTICAL APPROACH (John M. Davis, Oxford Press, $2^{nd}$ ed. 2002); and CURRENT PROTOCOLS IN MOLECULAR BIOLOGY, supra, (2004). These protocols are routine procedures within the scope of one skilled in the art and from the teaching herein.

The methods disclosed in the present specification include, in part, introducing into a cell a polynucleotide molecule. A polynucleotide molecule introduced into a cell can be transiently or stably maintained by that cell. Stably-maintained polynucleotide molecules may be extra-chromosomal and replicate autonomously, or they may be integrated into the chromosomal material of the cell and replicate non-autonomously. It is envisioned that any and all methods for introducing a polynucleotide molecule disclosed in the present specification into a cell can be used. Methods useful for introducing a nucleic acid molecule into a cell include, without limitation, chemical-mediated transfection such as, e.g., calcium phosphate-mediated, diethyl-aminoethyl (DEAE) dextran-mediated, lipid-mediated, polyethyleneimine (PEI)-mediated, polylysine-mediated and polybrene-mediated; physical-mediated tranfection, such as, e.g., biolistic particle delivery, microinjection, protoplast fusion and electroporation; and viral-mediated transfection, such as, e.g., retroviral-mediated transfection, see, e.g., Introducing Cloned Genes into Cultured Mammalian Cells, pp. 16.1-16.62 (Sambrook & Russell, eds., Molecular Cloning A Laboratory Manual, Vol. 3, $3^{rd}$ ed. 2001). One skilled in the art understands that selection of a specific method to introduce an expression construct into a cell will depend, in part, on whether the cell will transiently contain an expression construct or whether the cell will stably contain an expression construct. These protocols are routine procedures within the scope of one skilled in the art and from the teaching herein.

In an aspect of this embodiment, a chemical-mediated method, termed transfection, is used to introduce a polynucleotide molecule encoding a modified Clostridial toxin into a cell. In chemical-mediated methods of transfection the chemical reagent forms a complex with the nucleic acid that facilitates its uptake into the cells. Such chemical reagents include, without limitation, calcium phosphate-mediated, see, e.g., Martin Jordan & Florian Worm, Transfection of adherent and suspended cells by calcium phosphate, 33(2) Methods 136-143 (2004); diethyl-aminoethyl (DEAE) dextran-mediated, lipid-mediated, cationic polymer-mediated like polyethyleneimine (PEI)-mediated and polylysine-mediated and polybrene-mediated, see, e.g., Chun Zhang et al., Polyethylenimine strategies for plasmid delivery to brain-derived cells, 33(2) Methods 144-150 (2004). Such chemical-mediated delivery systems can be prepared by standard methods and are commercially available, see, e.g., CellPhect Transfection Kit (Amersham Biosciences, Piscataway, N.J.); Mammalian Transfection Kit, Calcium phosphate and DEAE Dextran, (Stratagene, Inc., La Jolla, Calif.); Lipofectamine™ Transfection Reagent (Invitrogen, Inc., Carlsbad, Calif.); ExGen 500 Transfection kit (Fermentas, Inc., Hanover, Md.), and SuperFect and Effectene Transfection Kits (Qiagen, Inc., Valencia, Calif.).

In another aspect of this embodiment, a physical-mediated method is used to introduce a polynucleotide molecule encoding a modified Clostridial toxin into a cell. Physical techniques include, without limitation, electroporation, biolistic and microinjection. Biolistics and microinjection techniques perforate the cell wall in order to introduce the nucleic acid molecule into the cell, see, e.g., Jeike E. Biewenga et al., Plasmid-mediated gene transfer in neurons using the biolistics technique, 71(1) J. Neurosci. Methods. 67-75 (1997); and John O'Brien & Sarah C. R. Lummis, Biolistic and diolistic transfection: using the gene gun to deliver DNA and lipophilic dyes into mammalian cells, 33(2) Methods 121-125 (2004). Electroporation, also termed electropermeabilization, uses brief, high-voltage, electrical pulses to create transient pores in the membrane through which the nucleic acid molecules enter and can be used effectively for stable and transient transfections of all cell types, see, e.g., M. Golzio et al., In vitro and in vivo electric field-mediated permeabilization, gene transfer, and expression, 33(2) Methods 126-135 (2004); and Oliver Greschet al., New non-viral method for gene transfer into primary cells, 33(2) Methods 151-163 (2004).

In another aspect of this embodiment, a viral-mediated method, termed transduction, is used to introduce a polynucleotide molecule encoding a modified Clostridial toxin into a cell. In viral-mediated methods of transient transduction, the process by which viral particles infect and replicate in a host cell has been manipulated in order to use this mechanism to introduce a nucleic acid molecule into the cell. Viral-mediated methods have been developed from a wide variety of viruses including, without limitation, retroviruses, adenoviruses, adeno-associated viruses, herpes simplex viruses, picornaviruses, alphaviruses and baculoviruses, see, e.g., Armin Blesch, Lentiviral and MLV based retroviral vectors for ex vivo and in vivo gene transfer, 33(2) Methods 164-172 (2004); and Maurizio Federico, From lentiviruses to lentivirus vectors, 229 Methods Mol. Biol. 3-15 (2003); E. M. Poeschla, Non-primate lentiviral vectors, 5(5) Curr. Opin. Mol. Ther. 529-540 (2003); Karim Benihoud et al, Adenovirus vectors for gene delivery, 10(5) Curr. Opin. Biotechnol. 440-447 (1999); H. Bueler, Adeno-associated viral vectors for gene transfer and gene therapy, 380(6) Biol. Chem. 613-622 (1999); Chooi M. Lai et al., Adenovirus and adeno-associated virus vectors, 21(12) DNA Cell Biol. 895-913 (2002); Edward A. Burton et al., Gene delivery using herpes simplex virus vectors, 21(12) DNA Cell Biol. 915-936 (2002); Paola Grandi et al., Targeting HSV amplicon vectors, 33(2) Methods 179-186 (2004); Ilya Frolov et al., Alphavirus-based expression vectors: strategies and applications, 93(21) Proc. Natl. Acad. Sci. U.S.A. 11371-11377 (1996); Markus U. Ehrengruber, Alphaviral gene transfer in neurobiology, 59(1) Brain Res. Bull. 13-22 (2002); Thomas A. Kost & J. Patrick Condreay, Recombinant baculoviruses as mammalian cell gene-delivery vectors, 20(4) Trends Biotechnol. 173-180 (2002); and A. Huser & C. Hofmann, Baculovirus vectors: novel mammalian cell gene-delivery vehicles and their applications, 3(1) Am. J. Pharmacogenomics 53-63 (2003).

Adenoviruses, which are non-enveloped, double-stranded DNA viruses, are often selected for mammalian cell transduction because adenoviruses handle relatively large polynucleotide molecules of about 36 kb, are produced at high titer, and can efficiently infect a wide variety of both dividing and non-dividing cells, see, e.g., Wim T. J. M. C. Hermens et al., Transient gene transfer to neurons and glia: analysis of adenoviral vector performance in the CNS and PNS, 71(1) J. Neurosci. Methods 85-98 (1997); and Hiroyuki Mizuguchi et al., Approaches for generating recombinant adenovirus vectors, 52(3) Adv. Drug Deliv. Rev. 165-176 (2001). Transduction using adenoviral-based system do not support prolonged protein expression because the nucleic acid molecule is carried from an episome in the cell nucleus, rather than being integrated into the host cell chromosome. Adenoviral vector systems and specific protocols for how to use such vectors are disclosed in, e.g., ViraPower™ Adenoviral Expression System (Invitrogen, Inc., Carlsbad, Calif.) and ViraPower™ Adenoviral Expression System Instruction Manual 25-0543 version A, Invitrogen, Inc., (Jul. 15, 2002); and AdEasy™ Adenoviral Vector System (Stratagene, Inc., La Jolla, Calif.) and AdEasy™ Adenoviral Vector System Instruction Manual 064004f, Stratagene, Inc.

Nucleic acid molecule delivery can also use single-stranded RNA retroviruses, such as, e.g., oncoretroviruses and lentiviruses. Retroviral-mediated transduction often produce transduction efficiencies close to 100%, can easily control the proviral copy number by varying the multiplicity of infection (MOI), and can be used to either transiently or stably transduce cells, see, e.g., Tiziana Tonini et al., Transient production of retroviral- and lentiviral-based vectors for the transduction of Mammalian cells, 285 Methods Mol. Biol. 141-148 (2004); Armin Blesch, Lentiviral and MLV based retroviral vectors for ex vivo and in vivo gene transfer, 33(2) Methods 164-172 (2004); Félix Recillas-Targa, Gene transfer and expression in mammalian cell lines and transgenic animals, 267 Methods Mol. Biol. 417-433 (2004); and Roland Wolkowicz et al., Lentiviral vectors for the delivery of DNA into mammalian cells, 246 Methods Mol. Biol. 391-411 (2004). Retroviral particles consist of an RNA genome packaged in a protein capsid, surrounded by a lipid envelope. The retrovirus infects a host cell by injecting its RNA into the cytoplasm along with the reverse transcriptase enzyme. The RNA template is then reverse transcribed into a linear, double stranded cDNA that replicates itself by integrating into the host cell genome. Viral particles are spread both vertically (from parent cell to daughter cells via the provirus) as well as horizontally (from cell to cell via virions). This replication strategy enables long-term persistent expression since the nucleic acid molecules of interest are stably integrated into a chromosome of the host cell, thereby enabling long-term expression of the protein. For instance, animal studies have shown that lentiviral vectors injected into a variety of tissues produced sustained protein expression for more than 1 year, see, e.g., Luigi Naldini et al., In vivo gene delivery and stable transduction of non-dividing cells by a lentiviral vector, 272 (5259) Science 263-267 (1996). The Oncoretroviruses-derived vector systems, such as, e.g., Moloney murine leukemia virus (MoMLV), are widely used and infect many different non-dividing cells. Lentiviruses can also infect many different cell types, including dividing and non-dividing cells and possess complex envelope proteins, which allows for highly specific cellular targeting.

Retroviral vectors and specific protocols for how to use such vectors are disclosed in, e.g., U.S. patent Nos. Manfred Gossen & Hermann Bujard, Tight control of gene expression in eukaryotic cells by tetracycline-responsive promoters, U.S. Pat. No. 5,464,758 (Nov. 7, 1995) and Hermann Bujard & Manfred Gossen, Methods for regulating gene expression, U.S. Pat. No. 5,814,618 (Sep. 29, 1998) David S. Hogness, Polynucleotides encoding insect steroid hormone receptor polypeptides and cells transformed with same, U.S. Pat. No. 5,514,578 (May 7, 1996) and David S. Hogness, Polynucleotide encoding insect ecdysone receptor, U.S. Pat. No. 6,245,531 (Jun. 12, 2001); Elisabetta Vegeto et al., Progesterone receptor having C. terminal hormone binding domain truncations, U.S. Pat. No. 5,364,791 (Nov. 15, 1994), Elisabetta Vegeto et al., Mutated steroid hormone receptors, methods for their use and molecular switch for gene therapy, U.S. Pat. No. 5,874,534 (Feb. 23, 1999) and Elisabetta Vegeto et al., Mutated steroid hormone receptors, methods for their use and molecular switch for gene therapy, U.S. Pat. No. 5,935,934 (Aug. 10, 1999). Furthermore, such viral delivery systems can be prepared by standard methods and are commercially available, see, e.g., BD™ Tet-Off and Tet-On Gene Expression Systems (BD Biosciences-Clonetech, Palo Alto, Calif.) and BD™ Tet-Off and Tet-On Gene Expression Systems User Manual, PT3001-1, BD Biosciences Clonetech, (Mar. 14, 2003), GeneSwitch™ System (Invitrogen, Inc., Carlsbad, Calif.) and GeneSwitch™ System A Mifepristone-Regulated Expression System for Mammalian Cells version D, 25-0313, Invitrogen, Inc., (Nov. 4, 2002); ViraPower™ Lentiviral Expression System (Invitrogen, Inc., Carlsbad, Calif.) and ViraPower™ Lentiviral Expression System Instruction Manual 25-0501 version E, Invitrogen, Inc., (Dec. 8, 2003); and Complete Control® Retroviral Inducible Mammalian Expression System (Stratagene, La Jolla, Calif.) and Complete Control® Retroviral Inducible Mammalian Expression System Instruction Manual, 064005e.

The methods disclosed in the present specification include, in part, expressing a modified Clostridial toxin from a polynucleotide molecule. It is envisioned that any of a variety of expression systems may be useful for expressing a modified Clostridial toxin from a polynucleotide molecule disclosed in the present specification, including, without limitation, cell-based systems and cell-free expression systems. Cell-based systems include, without limitation, viral expression systems, prokaryotic expression systems, yeast expression systems, baculoviral expression systems, insect expression systems and mammalian expression systems. Cell-free systems include, without limitation, wheat germ extracts, rabbit reticulocyte extracts and *E. coli* extracts and generally are equivalent to the method disclosed herein. Expression of a polynucleotide molecule using an expression system can include any of a variety of characteristics including, without limitation, inducible expression, non-inducible expression, constitutive expression, viral-mediated expression, stably-integrated expression, and transient expression. Expression systems that include well-characterized vectors, reagents, conditions and cells are well-established and are readily available from commercial vendors that include, without limitation, Ambion, Inc. Austin, Tex.; BD Biosciences-Clontech, Palo Alto, Calif.; BD Biosciences Pharmingen, San Diego, Calif.; Invitrogen, Inc, Carlsbad, Calif.; QIAGEN, Inc., Valencia, Calif.; Roche Applied Science, Indianapolis, Ind.; and Stratagene, La Jolla, Calif. Non-limiting examples on the selection and use of appropriate heterologous expression systems are described in e.g., PROTEIN EXPRESSION. A PRACTICAL APPROACH (S. J. Higgins and B. David Hames eds., Oxford University Press, 1999); Joseph M. Fernandez & James P. Hoeffler, GENE EXPRESSION SYSTEMS. USING NATURE FOR THE ART OF EXPRESSION (Academic Press, 1999); and Meena Rai & Harish Padh, *Expression Systems for Production of Heterologous Proteins*, 80(9) CURRENT SCIENCE 1121-1128, (2001). These protocols are routine procedures well within the scope of one skilled in the art and from the teaching herein.

A variety of cell-based expression procedures are useful for expressing a modified Clostridial toxin encoded by polynucleotide molecule disclosed in the present specification. Examples included, without limitation, viral expression systems, prokaryotic expression systems, yeast expression systems, baculoviral expression systems, insect expression systems and mammalian expression systems. Viral expression systems include, without limitation, the ViraPower™ Lentiviral (Invitrogen, Inc., Carlsbad, Calif.), the Adenoviral Expression Systems (Invitrogen, Inc., Carlsbad, Calif.), the AdEasy™ XL Adenoviral Vector System (Stratagene, La Jolla, Calif.) and the ViraPort® Retroviral Gene Expression System (Stratagene, La Jolla, Calif.). Non-limiting examples of prokaryotic expression systems include the Champion™ pET Expression System (EMD Biosciences-Novagen, Madison, Wis.), the TriEX™ Bacterial Expression Systems (EMD Biosciences-Novagen, Madison, Wis.), the QIAexpress® Expression System (QIAGEN, Inc.), and the Affinity® Protein Expression and Purification System (Stratagene, La Jolla, Calif.). Yeast expression systems include, without limitation, the EasySelect™ *Pichia* Expression Kit (Invitrogen, Inc., Carlsbad, Calif.), the YES-Echo™ Expression Vector Kits (Invitrogen, Inc., Carlsbad, Calif.) and the SpECTRA™ *S. pombe* Expression System (Invitrogen, Inc., Carlsbad, Calif.). Non-limiting examples of baculoviral expression systems include the BaculoDirect™ (Invitrogen, Inc., Carlsbad, Calif.), the Bac-to-Bac (Invitrogen, Inc., Carlsbad, Calif.), and the BD BaculoGold™ (BD Biosciences-Pharmigen, San Diego, Calif.). Insect expression systems include, without limitation, the *Drosophila* Expression System (DES®) (Invitrogen, Inc., Carlsbad, Calif.), InsectSelect™ System (Invitrogen, Inc., Carlsbad, Calif.) and InsectDirect™ System (EMD Biosciences-Novagen, Madison, Wis.). Non-limiting examples of mammalian expression systems include the T-REx™ (Tetracycline-Regulated Expression) System (Invitrogen, Inc., Carlsbad, Calif.), the Flp-In™ T-REx™ System (Invitrogen, Inc., Carlsbad, Calif.), the pcDNA™ system (Invitrogen, Inc., Carlsbad, Calif.), the pSecTag2 system (Invitrogen, Inc., Carlsbad, Calif.), the Exchanger® System, InterPlay™ Mammalian TAP System (Stratagene, La Jolla, Calif.), Complete Control® Inducible Mammalian Expression System (Stratagene, La Jolla, Calif.) and LacSwitch® II Inducible Mammalian Expression System (Stratagene, La Jolla, Calif.).

Another procedure of expressing a modified Clostridial toxin encoded by polynucleotide molecule disclosed in the present specification employs a cell-free expression system such as, without limitation, prokaryotic extracts and eukaryotic extracts. Non-limiting examples of prokaryotic cell extracts include the RTS 100 *E. coli* HY Kit (Roche Applied Science, Indianapolis, Ind.), the ActivePro In Vitro Translation Kit (Ambion, Inc., Austin, Tex.), the EcoPrO™ System (EMD Biosciences-Novagen, Madison, Wis.) and the Expressway™ Plus Expression System (Invitrogen, Inc., Carlsbad, Calif.). Eukaryotic cell extract include, without limitation, the RTS 100 Wheat Germ CECF Kit (Roche Applied Science, Indianapolis, Ind.), the TnT® Coupled Wheat Germ Extract Systems (Promega Corp., Madison, Wis.), the Wheat Germ IVT™ Kit (Ambion, Inc., Austin, Tex.), the Retic Lysate IVT™ Kit (Ambion, Inc., Austin, Tex.), the PROTEINscript® II System (Ambion, Inc., Austin, Tex.) and the TnT® Coupled Reticulocyte Lysate Systems (Promega Corp., Madison, Wis.).

Aspects of the present invention can also be described as follows:

1. A modified Clostridial toxin comprising:
   a) a PAR ligand domain;
   b) a Clostridial toxin enzymatic domain;
   c) a Clostridial toxin translocation domain; and
   d) a Clostridial toxin binding domain.

2. The modified Clostridial toxin according to 1, wherein the PAR ligand domain is operationally-linked to the amino terminus of the Clostridial toxin enzymatic domain.

3. The modified Clostridial toxin according to 2, wherein the modified Clostridial toxin comprises an amino to carboxyl single polypeptide linear order comprising the PAR ligand domain, the Clostridial toxin enzymatic domain, the Clostridial toxin translocation domain and the Clostridial toxin binding domain.

4. The modified Clostridial toxin according to 2, wherein the modified Clostridial toxin comprises an amino to carboxyl single polypeptide linear order comprising the PAR ligand domain, the Clostridial toxin enzymatic domain, the Clostridial toxin binding domain and the Clostridial toxin translocation domain.

5. The modified Clostridial toxin according to 1, wherein the PAR ligand domain is operationally-linked to the amino terminus of the Clostridial toxin translocation domain.

6. The modified Clostridial toxin according to 5, wherein the modified Clostridial toxin comprises an amino to carboxyl single polypeptide linear order comprising the Clostridial toxin binding domain, the Clostridial toxin enzymatic domain, the PAR ligand domain and the Clostridial toxin translocation domain.

7. The modified Clostridial toxin according to 5, wherein the modified Clostridial toxin comprises an amino to carboxyl single polypeptide linear order comprising the Clostridial toxin enzymatic domain, the PAR ligand domain, the Clostridial toxin translocation domain and the Clostridial toxin binding domain.

8. The modified Clostridial toxin according to 1, wherein the PAR ligand domain is operationally-linked to the amino terminus of the Clostridial toxin binding domain.

9. The modified Clostridial toxin according to 8, wherein the modified Clostridial toxin comprises an amino to carboxyl single polypeptide linear order comprising the Clostridial toxin enzymatic domain, the PAR ligand domain, the Clostridial toxin binding domain and the Clostridial toxin translocation domain.

10. The modified Clostridial toxin according to 1, wherein the modified Clostridial toxin further comprises a protease cleavage site; wherein cleavage of the protease cleavage site unmasks the PAR ligand domain.

11. The modified Clostridial toxin according to 1, wherein the PAR ligand domain comprises a PAR1 ligand domain.

12. The modified Clostridial toxin according to 11, wherein the PAR1 ligand domain comprises SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23 or SEQ ID NO: 133.

13. The modified Clostridial toxin according to 1, wherein the PAR ligand domain comprises a PAR2 ligand domain.

14. The modified Clostridial toxin according to 13, wherein the PAR2 ligand domain comprises SEQ ID NO: 24 or SEQ ID NO: 25.

15. The modified Clostridial toxin according to 1, wherein the PAR ligand domain comprises a PAR3 ligand domain.

16. The modified Clostridial toxin according to 15, wherein the PAR3 ligand domain comprises SEQ ID NO: 26, SEQ ID NO: 27 or SEQ ID NO: 134.

17. The modified Clostridial toxin according to 1, wherein the PAR ligand domain comprises a PAR4 ligand domain.

18. The modified Clostridial toxin according to 17, wherein the PAR4 ligand domain comprises SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 135 or SEQ ID NO: 160.

19. The modified Clostridial toxin according to 1, wherein the modified Clostridial toxin is a modified Botulinum toxin comprising a PAR ligand domain, a Botulinum toxin enzymatic domain, a Botulinum toxin translocation domain and a Botulinum toxin binding domain.

20. The modified Clostridial toxin according to 19, wherein the modified Botulinum toxin is a modified BoNT/A comprising a PAR ligand domain, a BoNT/A enzymatic domain, a BoNT/A translocation domain and a BoNT/A binding domain.

21. The modified Clostridial toxin according to 19, wherein the modified Botulinum toxin is a modified BoNT/B comprising a PAR ligand domain, a BoNT/B enzymatic domain, a BoNT/B translocation domain and a BoNT/B binding domain.

22. The modified Clostridial toxin according to 19, wherein the modified Botulinum toxin is a modified BoNT/C1 comprising a PAR ligand domain, a BoNT/C1 enzymatic domain, a BoNT/C1 translocation domain and a BoNT/C1 binding domain.

23. The modified Clostridial toxin according to 19, wherein the modified Botulinum toxin is a modified BoNT/D comprising a PAR ligand domain, a BoNT/D enzymatic domain, a BoNT/D translocation domain and a BoNT/D binding domain.

24. The modified Clostridial toxin according to 19, wherein the modified Botulinum toxin is a modified BoNT/E comprising a PAR ligand domain, a BoNT/E enzymatic domain, a BoNT/E translocation domain and a BoNT/E binding domain.

25. The modified Clostridial toxin according to 19, wherein the modified Botulinum toxin is a modified BoNT/F comprising a PAR ligand domain, a BoNT/F enzymatic domain, a BoNT/F translocation domain and a BoNT/F binding domain.

26. The modified Clostridial toxin according to 19, wherein the modified Botulinum toxin is a modified BoNT/G comprising a PAR ligand domain, a BoNT/G enzymatic domain, a BoNT/G translocation domain and a BoNT/G binding domain.

27. The modified Clostridial toxin according to 1, wherein the modified Clostridial toxin is a modified Tetanus toxin comprising a PAR ligand domain, a Tetanus toxin enzymatic domain, a Tetanus toxin translocation domain and a Tetanus toxin binding domain.

28. A polynucleotide molecule encoding a modified Clostridial toxin, the polynucleotide molecule comprising:
   a) polynucleotide molecule encoding a PAR ligand domain;
   b) polynucleotide molecule encoding a Clostridial toxin enzymatic domain;
   c) polynucleotide molecule encoding a Clostridial toxin translocation domain; and
   d) polynucleotide molecule encoding a Clostridial toxin binding domain.

29. The polynucleotide molecule according to 28, wherein the polynucleotide molecule encodes a polypeptide comprising the PAR ligand domain operationally-linked to the amino terminus of the Clostridial toxin enzymatic domain.

30. The polynucleotide molecule according to 29, wherein the polynucleotide molecule encodes a modified Clostridial toxin comprising an amino to carboxyl single polypeptide linear order comprising the PAR ligand domain, the Clostridial toxin enzymatic domain, the Clostridial toxin translocation domain and the Clostridial toxin binding domain.

31. The polynucleotide molecule according to 29, wherein the polynucleotide molecule encodes a modified Clostridial toxin comprising an amino to carboxyl single polypeptide linear order comprising the PAR ligand domain, the Clostridial toxin enzymatic domain, the Clostridial toxin binding domain and the Clostridial toxin translocation domain.

32. The polynucleotide molecule according to 28, wherein the polynucleotide molecule encodes a polypeptide comprising the PAR ligand domain operationally-linked to the amino terminus of the Clostridial toxin translocation domain.

33. The polynucleotide molecule according to 32, wherein the polynucleotide molecule encodes a modified Clostridial toxin comprising an amino to carboxyl single polypeptide linear order comprising the Clostridial toxin binding domain, the Clostridial toxin enzymatic domain, the PAR ligand domain and the Clostridial toxin translocation domain.

34. The polynucleotide molecule according to 32, wherein the polynucleotide molecule encodes a modified Clostridial toxin comprising an amino to carboxyl single polypeptide linear order comprising the Clostridial toxin enzymatic domain, the PAR ligand domain, the Clostridial toxin translocation domain and the Clostridial toxin binding domain.

35. The polynucleotide molecule according to 28, wherein the polynucleotide molecule encodes a polypeptide comprising the PAR ligand domain operationally-linked to the amino terminus of the Clostridial toxin binding domain.

36. The polynucleotide molecule according to 35, wherein the polynucleotide molecule encodes a modified Clostridial toxin comprising an amino to carboxyl single polypeptide linear order comprising the Clostridial toxin enzymatic domain, the PAR ligand domain, the Clostridial toxin binding domain and the Clostridial toxin translocation domain.

37. The polynucleotide molecule according to 28, wherein the polynucleotide molecule further encodes a protease cleavage site; wherein cleavage of the protease cleavage site unmasks the PAR ligand domain.

38. The polynucleotide molecule according to 28, wherein the polynucleotide molecule encoding the PAR ligand domain comprises a PAR1 ligand domain.

39. The polynucleotide molecule according to 38, wherein the polynucleotide molecule encodes the PAR1 ligand domain comprising SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23 or SEQ ID NO: 133.

40. The polynucleotide molecule according to 28, wherein the polynucleotide molecule encoding the PAR ligand domain comprises a PAR2 ligand domain.

41. The polynucleotide molecule according to 40, wherein the polynucleotide molecule encodes the PAR2 ligand domain comprises SEQ ID NO: 24 or SEQ ID NO: 25.

42. The polynucleotide molecule according to 28, wherein the polynucleotide molecule encoding the PAR ligand domain comprises a PAR3 ligand domain.

43. The polynucleotide molecule according to 42, wherein the polynucleotide molecule encodes the PAR3 ligand domain comprises SEQ ID NO: 26, SEQ ID NO: 27 or SEQ ID NO: 134.

44. The polynucleotide molecule according to 28, wherein the polynucleotide molecule encoding the PAR ligand domain comprises a PAR4 ligand domain.

45. The polynucleotide molecule according to 44, wherein the polynucleotide molecule encodes the PAR4 ligand domain comprises SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 135 or SEQ ID NO: 160.

46. The polynucleotide molecule according to 28, wherein the polynucleotide molecule encoding the modified Clostridial toxin comprises a polynucleotide molecule encoding a modified Botulinum toxin comprising a PAR ligand domain, a Botulinum toxin enzymatic domain, a Botulinum toxin translocation domain and a Botulinum toxin binding domain.

47. The modified Clostridial toxin according to 46, wherein the polynucleotide molecule encoding the modified Botulinum toxin comprises a polynucleotide molecule encoding a modified BoNT/A comprising a PAR ligand domain, a BoNT/A enzymatic domain, a BoNT/A translocation domain and a BoNT/A binding domain.

48. The modified Clostridial toxin according to 46, wherein the polynucleotide molecule encoding the modified Botulinum toxin comprises a polynucleotide molecule encoding a modified BoNT/B comprising a PAR ligand domain, a BoNT/B enzymatic domain, a BoNT/B translocation domain and a BoNT/B binding domain.

49. The modified Clostridial toxin according to 46, wherein the polynucleotide molecule encoding the modified Botulinum toxin comprises a polynucleotide molecule encoding a modified BoNT/C1 comprising a PAR ligand domain, a BoNT/C1 enzymatic domain, a BoNT/C1 translocation domain and a BoNT/C1 binding domain.

50. The modified Clostridial toxin according to 46, wherein the polynucleotide molecule encoding the modified Botulinum toxin comprises a polynucleotide molecule encoding a modified BoNT/D comprising a PAR ligand domain, a BoNT/D enzymatic domain, a BoNT/D translocation domain and a BoNT/D binding domain.

51. The modified Clostridial toxin according to 46, wherein the polynucleotide molecule encoding the modified Botulinum toxin comprises a polynucleotide molecule encoding a modified BoNT/E comprising a PAR ligand domain, a BoNT/E enzymatic domain, a BoNT/E translocation domain and a BoNT/E binding domain.

52. The modified Clostridial toxin according to 46, wherein the polynucleotide molecule encoding the modified Botulinum toxin comprises a polynucleotide molecule encoding a modified BoNT/F comprising a PAR ligand domain, a BoNT/F enzymatic domain, a BoNT/F translocation domain and a BoNT/F binding domain.

53. The modified Clostridial toxin according to 46, wherein the polynucleotide molecule encoding the modified Botulinum toxin comprises a polynucleotide molecule encoding a modified BoNT/G comprising a PAR ligand domain, a BoNT/G enzymatic domain, a BoNT/G translocation domain and a BoNT/G binding domain.

54. The modified Clostridial toxin according to 28, wherein the polynucleotide molecule encoding the modified Clostridial toxin comprises a polynucleotide molecule encoding a modified Tetanus toxin comprising a PAR ligand domain, a Tetanus toxin enzymatic domain, a Tetanus toxin translocation domain and a Tetanus toxin binding domain.

55. A method of producing a modified Clostridial toxin comprising the step of expressing a modified Clostridial toxin encoded by a polynucleotide molecule in a cell, wherein the modified Clostridial toxin comprising a PAR ligand domain; a Clostridial toxin enzymatic domain; a Clostridial toxin translocation domain; and a Clostridial toxin binding domain.

56. A methods of producing a modified Clostridial toxin comprising the steps of:
   a. introducing into a cell a polynucleotide molecule encoding a modified Clostridial toxin comprising a PAR ligand domain; a Clostridial toxin enzymatic domain; a Clostridial toxin translocation domain; and a Clostridial toxin binding domain; and
   b. expressing the modified Clostridial toxin encoded by the polynucleotide molecule.

57. A modified Clostridial toxin comprising:
   a) a PAR ligand domain;
   b) a Clostridial toxin enzymatic domain;
   c) a Clostridial toxin translocation domain; and
   d) a non-Clostridial toxin binding domain.

58. The modified Clostridial toxin according to 57, wherein the non-Clostridial toxin binding domain is selected from the group consisting of a Nerve growth factor (NGF), a Leukemia inhibitory factor (LIF), a Basic fibroblast growth factor (bFGF), a Brain-derived neurotrophic factor (BDNF), a Neurotrophin-3 (NT-3), a Hydra head activator peptide (HHAP), a Transforming growth factor 1 (TGF-1), a Transforming growth factor 2 (TGF-2), a Transforming growth factor 3(TGF-3), an Epidermal growth factor (EGF) or a Ciliary neurotrophic factor (CNTF).

59. The modified Clostridial toxin according to 57, wherein the non-Clostridial toxin binding domain is selected from the group consisting of a Tumor necrosis factor (TNF-), an Interleukin-1 (IL-1), an Interleukin-1 (IL-1) or an Interleukin-8 (IL-8).

60. The modified Clostridial toxin according to 57, wherein the non-Clostridial toxin binding domain is selected from the group consisting of a Bradykinin, a Dynorphin, a β-endorphin, an Etorphine, an Endomorphin-1, an Endomorphin-2, a Leu-enkephalin, a Met-enkephalin, a Galanin, a Lofentanil or a Nociceptin.

61. The modified Clostridial toxin according to 57, wherein the non-Clostridial toxin binding domain is selected from the group consisting of an antibody against the lactoseries carbohydrate epitopes found on the surface of dorsal root ganglion neurons (e.g. monoclonal antibodies 1B2 and LA4), an antibody against any of the receptors for the binding domains given above or an antibody against the surface expressed antigen Thyl (e.g. monoclonal antibody MRC OX7).

EXAMPLES

The following non-limiting examples are provided for illustrative purposes only in order to facilitate a more complete understanding of disclosed embodiments and are in no way intended to limit any of the embodiments disclosed in the present specification.

Example 1

Construction of BoNT/A-ED-PAR1Tb

This example illustrates how to make a modified Clostridial toxin comprising a PAR binding domain located at the amino terminus of the light chain comprising the enzymatic domain.

A polynucleotide molecule (SEQ ID NO: 109) based on BoNT/A-ED-PAR1Tb (SEQ ID NO: 85) is synthesized using standard procedures (BlueHeron® Biotechnology, Bothell, Wash.). Oligonucleotides of 20 to 50 bases in length are synthesized using standard phosphoramidite synthesis. These oligonucleotides are hybridized into double stranded duplexes that are ligated together to assemble the full-length polynucleotide molecule. This polynucleotide molecule is cloned using standard molecular biology methods into a pUCBHB1 vector at the SmaI site to generate pUCBHB1/BoNT/A-ED-PAR1Tb. The synthesized polynucleotide molecule is verified by sequencing using Big Dye Terminator™ Chemistry 3.1 (Applied Biosystems, Foster City, Calif.) and an ABI 3100 sequencer (Applied Biosystems, Foster City, Calif.).

If desired, an expression optimized polynucleotide molecule (SEQ ID NO: 136) based on BoNT/A-ED-PAR1Tb (SEQ ID NO: 85) can be synthesized in order to improve expression in an *Escherichia coli* strain. The polynucleotide molecule encoding the BoNT/A-ED-PAR1Tb can be modified to 1) contain synonymous codons typically present in native polynucleotide molecules of an *Escherichia coli* strain; 2) contain a G+C content that more closely matches the average G+C content of native polynucleotide molecules found in an *Escherichia coli* strain; 3) reduce polymononucleotide regions found within the polynucleotide molecule; and/or 4) eliminate internal regulatory or structural sites found within the polynucleotide molecule, see, e.g., Lance E. Steward et al. Optimizing Expression of Active Botulinum Toxin Type E, PCT Patent Serial No. 2005/020578 (Jun. 9, 2005); Lance E. Steward et al. Optimizing Expression of Active Botulinum Toxin Type A, PCT Patent Serial No. 2005/XXXXXX (Aug. 3, 2005). Once sequence optimization is complete, oligonucleotides of 20 to 50 bases in length are synthesized using standard phosphoramidite synthesis. These oligonucleotides are hybridized into double stranded duplexes that are ligated together to assemble the full-length polynucleotide molecule. This polynucleotide molecule is cloned using standard molecular biology methods into a pUCBHB1 vector at the SmaI site to generate pUCBHB1/BoNT/A-ED-PAR1Tb. The synthesized polynucleotide molecule is verified by sequencing using Big Dye Terminator™ Chemistry 3.1 (Applied Biosystems, Foster City, Calif.) and an ABI 3100 sequencer (Applied Biosystems, Foster City, Calif.). Is so desired, optimization to a different organism, such as, e.g., a yeast strain, an insect cell-line or a mammalian cell line, can be done, see, e.g., Steward, supra, PCT Patent Serial No. 2005/020578 (Jun. 9, 2005); and Steward, supra, PCT Patent Serial No. 2005/XXXXXX (Aug. 3, 2005).

A similar cloning strategy is used to make pUCBHB1 cloning constructs comprising the polynucleotide molecule of SEQ ID NO: 110 or SEQ ID NO: 137 encoding BoNT/A-ED-PAR1Xa of SEQ ID NO: 86; the polynucleotide molecule of SEQ ID NO: 111 or SEQ ID NO: 138 encoding BoNT/A-ED-PAR2Tp of SEQ ID NO: 87; the polynucleotide molecule of SEQ ID NO: 112 or SEQ ID NO: 139 encoding BoNT/A-ED-PAR2Xa of SEQ ID NO: 88; the polynucleotide molecule of SEQ ID NO: 113 or SEQ ID NO: 140 encoding BoNT/A-ED-PAR3Tb of SEQ ID NO: 89; the polynucleotide molecule of SEQ ID NO: 114 or SEQ ID NO: 141 encoding BoNT/A-ED-PAR3Xa of SEQ ID NO: 90; the polynucleotide molecule of SEQ ID NO: 115 or SEQ ID NO: 142 encoding BoNT/A-ED-PAR4Tb of SEQ ID NO: 91; and the polynucleotide molecule of SEQ ID NO: 116 or SEQ ID NO: 143 encoding BoNT/A-ED-PAR4Xa of SEQ ID NO: 92. In addition, one skilled in the art can modify Clostridial toxins, such as, e.g., BoNT/B, BoNT/C1, BoNT/D. BoNT/E, BoNT/F, BoNT/G and TeNT, so that these toxins possess the PAR attributes of the modified BoNT/A described above and make them using similar cloning strategy.

Figure 7:
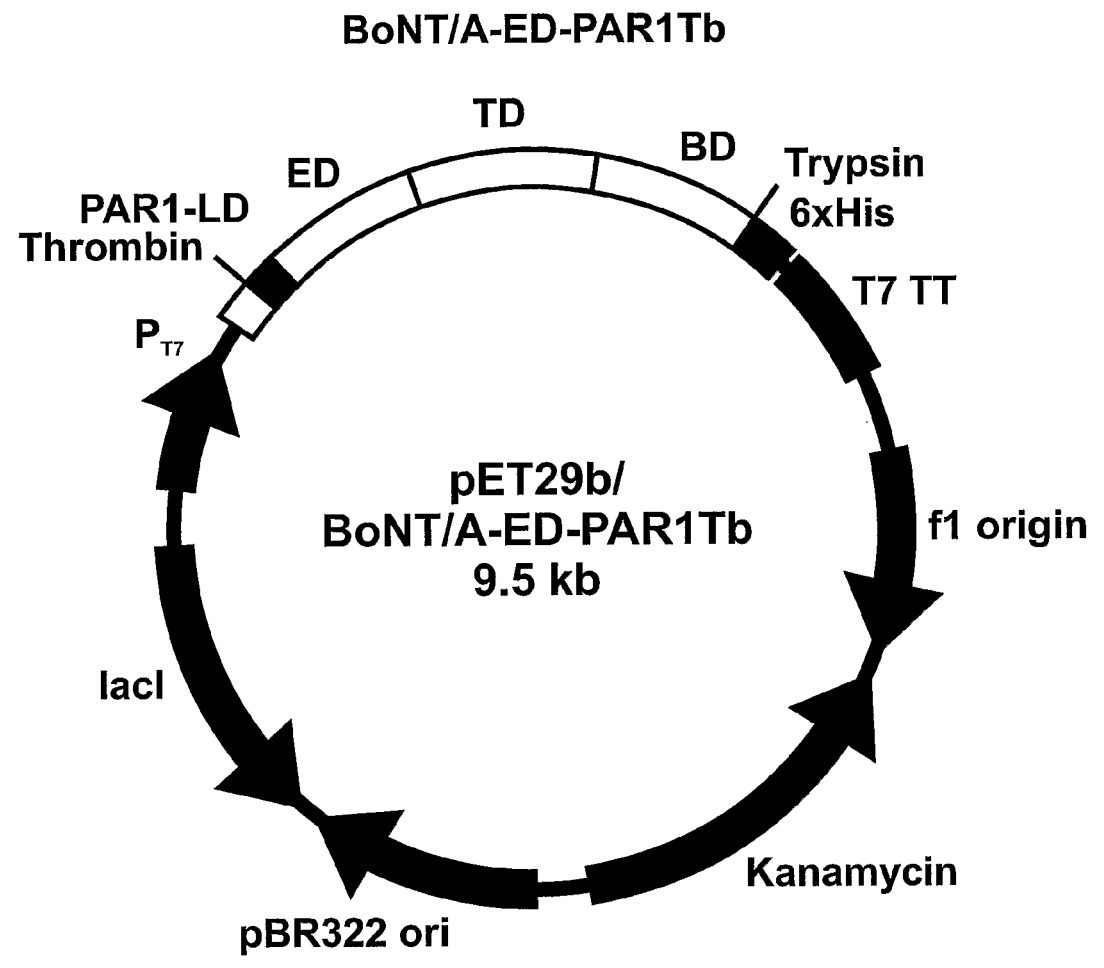

To construct pET29/BoNT/A-ED-PAR1Tb, a pUCBHB1/BoNT/A-ED-PAR1Tb construct is digested with restriction endonucleases that 1) excise the insert comprising the open reading frame of SEQ ID NO: 136 encoding BoNT/A-ED-PAR1Tb; and 2) enable this insert to be operably-linked to a pET29 vector (EMD Biosciences-Novagen, Madison, Wis.). This insert is subcloned using a T4 DNA ligase procedure into a pET29 vector that is digested with appropriate restriction endonucleases to yield pET29/BoNT/A-ED-PAR1Tb. The ligation mixture is transformed into chemically competent *E. coli* DH5α cells (Invitrogen, Inc, Carlsbad, Calif.) using a heat shock method, plated on 1.5% Luria-Bertani agar plates (pH 7.0) containing 50 μg/mL of Kanamycin, and placed in a 37° C. incubator for overnight growth. Bacteria containing expression constructs are identified as Kanamycin resistant colonies. Candidate constructs are isolated using an alkaline lysis plasmid mini-preparation procedure and analyzed by restriction endonuclease digest mapping to determine the presence and orientation of the insert. This cloning strategy yielded a pET29 expression construct comprising the polynucleotide molecule of SEQ ID NO: 136 encoding the BoNT/A-ED-PAR1Tb of SEQ ID NO: 85 operably-linked to a carboxyl terminal polyhistidine affinity binding peptide (FIG. 7).

A similar cloning strategy is used to make pET29 expression constructs comprising the polynucleotide molecule of SEQ ID NO: 109 encoding BoNT/A-ED-PAR1Tb of SEQ ID NO: 85; SEQ ID NO: 110 or SEQ ID NO: 137 encoding BoNT/A-ED-PAR1Xa of SEQ ID NO: 86; the polynucleotide molecule of SEQ ID NO: 111 or SEQ ID NO: 138 encoding BoNT/A-ED-PAR2Tp of SEQ ID NO: 87; the polynucleotide molecule of SEQ ID NO: 112 or SEQ ID NO: 139 encoding BoNT/A-ED-PAR2Xa of SEQ ID NO: 88; the polynucleotide molecule of SEQ ID NO: 113 or SEQ ID NO: 140 encoding BoNT/A-ED-PAR3Tb of SEQ ID NO: 89; the polynucleotide molecule of SEQ ID NO: 114 or SEQ ID NO: 141 encoding BoNT/A-ED-PAR3Xa of SEQ ID NO: 90; the polynucleotide molecule of SEQ ID NO: 115 or SEQ ID NO: 142 encoding BoNT/A-ED-PAR4Tb of SEQ ID NO: 91; and the polynucleotide molecule of SEQ ID NO: 116 or SEQ ID NO: 143 encoding BoNT/A-ED-PAR4Xa of SEQ ID NO: 92.

Example 2

Construction of BoNT/A-TD-PAR1Tb

This example illustrates how to make a modified Clostridial toxin comprising a PAR binding domain located at the amino terminus of the heavy chain region comprising the translocation domain.

A polynucleotide molecule (SEQ ID NO: 117) based on BoNT/A-TD-PAR1Tb (SEQ ID NO: 93) is synthesized using standard procedures (BlueHeron® Biotechnology, Bothell, Wash.). Oligonucleotides of 20 to 50 bases in length are synthesized using standard phosphoramidite synthesis. These oligonucleotides are hybridized into double stranded duplexes that are ligated together to assemble the full-length polynucleotide molecule. This polynucleotide molecule is cloned using standard molecular biology methods into a pUCBHB1 vector at the SmaI site to generate pUCBHB1/BoNT/A-TD-PAR1Tb. The synthesized polynucleotide molecule is verified by sequencing using Big Dye Terminator™ Chemistry 3.1 (Applied Biosystems, Foster City, Calif.) and an ABI 3100 sequencer (Applied Biosystems, Foster City, Calif.).

If desired, an expression optimized polynucleotide molecule (SEQ ID NO: 144) based on BoNT/A-TD-PAR1Tb (SEQ ID NO: 93) can be synthesized in order to improve expression in an *Escherichia coli* strain. The open reading frame comprising the polynucleotide molecule is optimized to improve expression in an *Escherichia coli* strain. The polynucleotide molecule encoding the BoNT/A-TD-PAR1Tb can be modified to 1) contain synonymous codons typically present in native polynucleotide molecules of an *Escherichia coli* strain; 2) contain a G+C content that more closely matches the average G+C content of native polynucleotide molecules found in an *Escherichia coli* strain; 3) reduce polymononucleotide regions found within the polynucleotide molecule; and/or 4) eliminate internal regulatory or structural sites found within the polynucleotide molecule, see, e.g., Lance E. Steward et al. Optimizing Expression of Active Botulinum Toxin Type E, PCT Patent Serial No. 2005/020578 (Jun. 9, 2005); Lance E. Steward et al. Optimizing Expression of Active Botulinum Toxin Type A, PCT Patent Serial No. 2005/XXXXXX (Aug. 3, 2005). Once sequence optimization is complete, oligonucleotides of 20 to 50 bases in length are synthesized using standard phosphoramidite synthesis. These oligonucleotides are hybridized into double stranded duplexes that are ligated together to assemble the full-length polynucleotide molecule. This polynucleotide molecule is cloned using standard molecular biology methods into a pUCBHB1 vector at the SmaI site to generate BoNT/A-TD-PAR1Tb. The synthesized polynucleotide molecule is verified by sequencing using Big Dye Terminator™ Chemistry 3.1 (Applied Biosystems, Foster City, Calif.) and an ABI 3100 sequencer (Applied Biosystems, Foster City, Calif.). Is so desired, optimization of the polynucleotide molecule encoding a BoNT/A-TD-PAR1Tb need not be performed, or optimization to a different organism, such as, e.g., a yeast strain, an insect cell-line or a mammalian cell line, can be done instead, see, e.g., Steward, supra, PCT Patent Serial No. 2005/020578 (Jun. 9, 2005); and Steward, supra, PCT Patent Serial No. 2005/XXXXXX (Aug. 3, 2005).

A similar cloning strategy is used to make pUCBHB1 cloning constructs comprising the polynucleotide molecule of SEQ ID NO: 118 or SEQ ID NO: 145 encoding BoNT/A-TD-PAR1Xa of SEQ ID NO: 94; the polynucleotide molecule of SEQ ID NO: 119 or SEQ ID NO: 146 encoding BoNT/A-TD-PAR2Tp of SEQ ID NO: 95; the polynucleotide molecule of SEQ ID NO: 120 or SEQ ID NO: 147 encoding BoNT/A-TD-PAR2Xa of SEQ ID NO: 96; the polynucleotide molecule of SEQ ID NO: 121 or SEQ ID NO: 148 encoding BoNT/A-TD-PAR1Tb of SEQ ID NO: 97; the polynucleotide molecule of SEQ ID NO: 122 or SEQ ID NO: 149 encoding BoNT/A-TD-PAR3Xa of SEQ ID NO: 98; the polynucleotide molecule of SEQ ID NO: 123 or SEQ ID NO: 150 encoding BoNT/A-TD-PAR4Tb of SEQ ID NO: 99; and the polynucleotide molecule of SEQ ID NO: 124 or SEQ ID NO: 151 encoding BoNT/A-TD-PAR4Xa of SEQ ID NO: 100. In addition, one skilled in the art can modify Clostridial toxins, such as, e.g., BoNT/B, BoNT/C1, BoNT/D. BoNT/E, BoNT/F, BoNT/G and TeNT, so that these toxins possess the PAR attributes of the modified BoNT/A described above and make them using similar cloning strategy.

To construct pET29/BoNT/A-TD-PAR1Tb, a pUCBHB1/ BoNT/A-TD-PAR1Tb construct is digested with restriction endonucleases that 1) excise the insert comprising the open reading frame of SEQ ID NO: 144 encoding BoNT/A-TD-PAR1Tb; and 2) enable this insert to be operably-linked to a pET29 vector (EMD Biosciences-Novagen, Madison, Wis.). This insert is subcloned using a T4 DNA ligase procedure into a pET29 vector that is digested with appropriate restriction endonucleases to yield pET29/BoNT/A-TD-PAR1Tb. The ligation mixture is transformed into chemically competent E. coli DH5α cells (Invitrogen, Inc, Carlsbad, Calif.) using a heat shock method, plated on 1.5% Luria-Bertani agar plates (pH 7.0) containing 50 μg/mL of Kanamycin, and placed in a 37° C. incubator for overnight growth. Bacteria containing expression constructs are identified as Kanamycin resistant colonies. Candidate constructs are isolated using an alkaline lysis plasmid mini-preparation procedure and analyzed by restriction endonuclease digest mapping to determine the presence and orientation of the insert. This cloning strategy yielded a pET29 expression construct comprising the polynucleotide molecule of SEQ ID NO: 144 encoding the BoNT/ A-TD-PAR1Tb of SEQ ID NO: 93 operably-linked to a carboxyl terminal polyhistidine affinity binding peptide (FIG. 8).

A similar cloning strategy is used to make pET29 expression constructs comprising the polynucleotide molecule of SEQ ID NO: 117 encoding BoNT/A-TD-PAR1Xa of SEQ ID NO: 93; SEQ ID NO: 118 or SEQ ID NO: 145 encoding BoNT/A-TD-PAR1Xa of SEQ ID NO: 94; the polynucleotide molecule of SEQ ID NO: 119 or SEQ ID NO: 146 encoding BoNT/A-TD-PAR2Tp of SEQ ID NO: 95; the polynucleotide molecule of SEQ ID NO: 120 or SEQ ID NO: 147 encoding BoNT/A-TD-PAR2Xa of SEQ ID NO: 96; the polynucleotide molecule of SEQ ID NO: 121 or SEQ ID NO: 148 encoding BoNT/A-TD-PAR1Tb of SEQ ID NO: 97; the polynucleotide molecule of SEQ ID NO: 122 or SEQ ID NO: 149 encoding BoNT/A-TD-PAR3Xa of SEQ ID NO: 98; the polynucleotide molecule of SEQ ID NO: 123 or SEQ ID NO: 150 encoding BoNT/A-TD-PAR4Tb of SEQ ID NO: 99; and the polynucleotide molecule of SEQ ID NO: 124 or SEQ ID NO: 151 encoding BoNT/A-TD-PAR4Xa of SEQ ID NO: 100.

Example 3

Construction of BoNT/A-BD-PAR1Tb

This example illustrates how to make a modified Clostridial toxin comprising a PAR binding domain located at the amino terminus of the heavy chain region comprising the binding domain.

A polynucleotide molecule (SEQ ID NO: 125) based on BoNT/A-BD-PAR1Tb (SEQ ID NO: 101) is synthesized using standard procedures (BlueHeron® Biotechnology, Bothell, Wash.). Oligonucleotides of 20 to 50 bases in length are synthesized using standard phosphoramidite synthesis. These oligonucleotides are hybridized into double stranded duplexes that are ligated together to assemble the full-length polynucleotide molecule. This polynucleotide molecule is cloned using standard molecular biology methods into a pUCBHB1 vector at the SmaI site to generate pUCBHB1/ BoNT/A-BD-PAR1Tb. The synthesized polynucleotide molecule is verified by sequencing using Big Dye Terminator™ Chemistry 3.1 (Applied Biosystems, Foster City, Calif.) and an ABI 3100 sequencer (Applied Biosystems, Foster City, Calif.).

If desired, an expression optimized polynucleotide molecule (SEQ ID NO: 152) based on BoNT/A-BD-PAR1Tb (SEQ ID NO: 101) can be synthesized in order to improve expression in an Escherichia Coli strain. The open reading frame comprising the polynucleotide molecule is optimized to improve expression in an Escherichia coli strain. The polynucleotide molecule encoding the BoNT/A-BD-PAR1Tb can be modified to 1) contain synonymous codons typically present in native polynucleotide molecules of an Escherichia coli strain; 2) contain a G+C content that more closely matches the average G+C content of native polynucleotide molecules found in an Escherichia coli strain; 3) reduce polymononucleotide regions found within the polynucleotide molecule; and/or 4) eliminate internal regulatory or structural sites found within the polynucleotide molecule, see, e.g., Lance E. Steward et al. Optimizing Expression of Active Botulinum Toxin Type E, PCT Patent Serial No. 2005/020578 (Jun. 9, 2005); Lance E. Steward et al. Optimizing Expression of Active Botulinum Toxin Type A, PCT Patent Serial No. 2005/XXXXXX (Aug. 3, 2005). Once sequence optimization is complete, oligonucleotides of 20 to 50 bases in length are synthesized using standard phosphoramidite synthesis. These oligonucleotides are hybridized into double stranded duplexes that are ligated together to assemble the full-length polynucleotide molecule. This polynucleotide molecule is cloned using standard molecular biology methods into a pUCBHB1 vector at the SmaI site to generate BoNT/A-BD-PAR1Tb. The synthesized polynucleotide molecule is verified by sequencing using Big Dye Terminator™ Chemistry 3.1 (Applied Biosystems, Foster City, Calif.) and an ABI 3100 sequencer (Applied Biosystems, Foster City, Calif.). Is so desired, optimization of the polynucleotide molecule encoding a BoNT/A-BD-PAR1Tb need not be performed, or optimization to a different organism, such as, e.g., a yeast strain, an insect cell-line or a mammalian cell line, can be done instead, see, e.g., Steward, supra, PCT Patent Serial No. 2005/020578 (Jun. 9, 2005); and Steward, supra, PCT Patent Serial No. 2005/XXXXXX (Aug. 3, 2005).

A similar cloning strategy is used to make pUCBHB1 cloning constructs comprising the polynucleotide molecule of SEQ ID NO: 126 or SEQ ID NO: 153 encoding BoNT/A-BD-PAR1Xa of SEQ ID NO: 102; the polynucleotide molecule of SEQ ID NO: 127 or SEQ ID NO: 154 encoding BoNT/A-BD-PAR2Tp of SEQ ID NO: 103; the polynucleotide molecule of SEQ ID NO: 128 or SEQ ID NO: 155 encoding BoNT/A-BD-PAR2Xa of SEQ ID NO: 104; the polynucleotide molecule of SEQ ID NO: 129 or SEQ ID NO: 156 encoding BoNT/A-BD-PAR3Tb of SEQ ID NO: 105; the polynucleotide molecule of SEQ ID NO: 130 or SEQ ID NO: 157 encoding BoNT/A-BD-PAR3Xa of SEQ ID NO: 106; the polynucleotide molecule of SEQ ID NO: 131 or SEQ ID NO: 158 encoding BoNT/A-BD-PAR4Tb of SEQ ID NO: 107; and the polynucleotide molecule of SEQ ID NO: 132 or SEQ ID NO: 159 encoding BoNT/A-BD-PAR4Xa of SEQ ID NO: 108. In addition, one skilled in the art can modify Clostridial toxins, such as, e.g., BoNT/B, BoNT/C1, BoNT/D. BoNT/E, BoNT/F, BoNT/G and TeNT, so that these toxins possess the PAR attributes of the modified BoNT/A described above and make them using similar cloning strategy.

To construct pET29/BoNT/A-BD-PAR1Tb, a pUCBHB1/ BoNT/A-BD-PAR1Tb construct is digested with restriction endonucleases that 1) excise the insert comprising the open reading frame of SEQ ID NO: 152 encoding BoNT/A-BD-PAR1Tb; and 2) enable this insert to be operably-linked to a pET29 vector (EMD Biosciences-Novagen, Madison, Wis.). This insert is subcloned using a T4 DNA ligase procedure into a pET29 vector that is digested with appropriate restriction endonucleases to yield pET29/BoNT/A-BD-PAR1Tb. The ligation mixture is transformed into chemically competent *E. coli* DH5α cells (Invitrogen, Inc, Carlsbad, Calif.) using a heat shock method, plated on 1.5% Luria-Bertani agar plates (pH 7.0) containing 50 µg/mL of Kanamycin, and placed in a 37° C. incubator for overnight growth. Bacteria containing expression constructs are identified as Kanamycin resistant colonies. Candidate constructs are isolated using an alkaline lysis plasmid mini-preparation procedure and analyzed by restriction endonuclease digest mapping to determine the presence and orientation of the insert. This cloning strategy yielded a pET29 expression construct comprising the polynucleotide molecule of SEQ ID NO: 152 encoding the BoNT/A-BD-PAR1Tb of SEQ ID NO: 101 operably-linked to a carboxyl terminal polyhistidine affinity binding peptide (FIG. 9).

A similar cloning strategy is used to make pET29 expression constructs comprising the polynucleotide molecule of SEQ ID NO: 125 encoding BoNT/A-BD-PAR1Tb of SEQ ID NO: 101; the polynucleotide molecule of SEQ ID NO: 126 or SEQ ID NO: 153 encoding BoNT/A-BD-PAR1Xa of SEQ ID NO: 102; the polynucleotide molecule of SEQ ID NO: 127 or SEQ ID NO: 154 encoding BoNT/A-BD-PAR2Tp of SEQ ID NO: 103; the polynucleotide molecule of SEQ ID NO: 128 or SEQ ID NO: 155 encoding BoNT/A-BD-PAR2Xa of SEQ ID NO: 104; the polynucleotide molecule of SEQ ID NO: 129 or SEQ ID NO: 156 encoding BoNT/A-BD-PAR3Tb of SEQ ID NO: 105; the polynucleotide molecule of SEQ ID NO: 130 or SEQ ID NO: 157 encoding BoNT/A-BD-PAR3Xa of SEQ ID NO: 106; the polynucleotide molecule of SEQ ID NO: 131 or SEQ ID NO: 158 encoding BoNT/A-BD-PAR4Tb of SEQ ID NO: 107; and the polynucleotide molecule of SEQ ID NO: 132 or SEQ ID NO: 159 encoding BoNT/A-BD-PAR4Xa of SEQ ID NO: 108.

Example 4

Expression of Modified Clostridial Toxins in a Bacterial Cell

The following example illustrates a procedure useful for expressing any of the modified Clostridial toxins disclosed in the present specification in a bacterial cell.

An expression construct, such as, e.g., pET29/BoNT/A-ED-PAR1Tb, pET29/BoNT/A-TD-PAR1Tb or pET29/BoNT/A-BD-PAR1Tb, see, e.g., Examples 1, 2 and 3, is introduced into chemically competent *E. coli* BL21 (DE3) cells (Invitrogen, Inc, Carlsbad, Calif.) using a heat-shock transformation protocol. The heat-shock reaction is plated onto 1.5% Luria-Bertani agar plates (pH 7.0) containing 50/g/mL of Kanamycin and is placed in a 37° C. incubator for overnight growth. Kanamycin-resistant colonies of transformed *E. coli* containing the expression construct, such as, e.g., pET29/BoNT/A-ED-PAR1Tb, pET29/BoNT/A-TD-PAR1Tb or pET29/BoNT/A-BD-PAR1Tb, are used to inoculate a baffled flask containing 3.0 mL of PA-0.5G media containing 50 µg/mL of Kanamycin which is then placed in a 37° C. incubator, shaking at 250 rpm, for overnight growth. The resulting overnight starter culture is in turn used to inoculate a 3 L baffled flask containing ZYP-5052 autoinducing media containing 50 µg/mL of Kanamycin at a dilution of 1:1000. Culture volumes ranged from about 600 mL (20% flask volume) to about 750 mL (25% flask volume). These cultures are grown in a 37° C. incubator shaking at 250 rpm for approximately 5.5 hours and are then transferred to a 16° C. incubator shaking at 250 rpm for overnight expression. Cells are harvested by centrifugation (4,000 rpm at 4° C. for 20-30 minutes) and are used immediately, or stored dry at −80° C. until needed.

Example 5

Purification and Quantification of Modified Clostridial Toxins

The following example illustrates methods useful for purification and quantification of any modified Clostridial toxins disclosed in the present specification.

For immobilized metal affinity chromatography (IMAC) protein purification, *E. coli* BL21 (DE3) cell pellets used to express a modified Clostridial toxin, as described in Example 4, are resuspended in Column Binding Buffer (25 mM N-(2-hydroxyethyl) piperazine-N'-(2-ethanesulfonic acid) (HEPES), pH 7.8; 500 mM sodium chloride; 10 mM imidazole; 2× Protease Inhibitor Cocktail Set III (EMD Biosciences-Calbiochem, San Diego Calif.); 5 units/mL of Benzonase (EMD Biosciences-Novagen, Madison, Wis.); 0.1% (v/v) Triton-X® 100, 4-octylphenol polyethoxylate; 10% (v/v) glycerol), and then are transferred to a cold Oakridge centrifuge tube. The cell suspension is sonicated on ice (10-12 pulses of 10 seconds at 40% amplitude with 60 seconds cooling intervals on a Branson Digital Sonifier) in order to lyse the cells and then is centrifuged (16,000 rpm at 4° C. for 20 minutes) to clarify the lysate. An immobilized metal affinity chromatography column is prepared using a 20 mL Econo-Pac column support (Bio-Rad Laboratories, Hercules, Calif.) packed with 2.5-5.0 mL of TALON™ SuperFlow $Co^{2+}$ affinity resin (BD Biosciences-Clontech, Palo Alto, Calif.), which is then equilibrated by rinsing with 5 column volumes of deionized, distilled water, followed by 5 column volumes of Column Binding Buffer. The clarified lysate is applied slowly to the equilibrated column by gravity flow (approximately 0.25-0.3 mL/minute). The column is then washed with 5 column volumes of Column Wash Buffer (N-(2-hydroxyethyl) piperazine-N'-(2-ethanesulfonic acid) (HEPES), pH 7.8; 500 mM sodium chloride; 10 mM imidazole; 0.1% (v/v) Triton-X® 100, 4-octylphenol polyethoxylate; 10% (v/v) glycerol). The Clostridial toxin is eluted with 20-30 mL of Column Elution Buffer (25 mM N-(2-hydroxyethyl) piperazine-N'-(2-ethanesulfonic acid) (HEPES), pH 7.8; 500 mM sodium chloride; 500 mM imidazole; 0.1% (v/v) Triton-X® 100, 4-octylphenol polyethoxylate; 10% (v/v) glycerol) and is collected in approximately twelve 1 mL fractions. The amount of Clostridial toxin contained in each elution fraction is determined by a Bradford dye assay. In this procedure, 20 µL aliquots of each 1.0 mL fraction is combined with 200 µL of Bio-Rad Protein Reagent (Bio-Rad Laboratories, Hercules, Calif.), diluted 1 to 4 with deionized, distilled water, and then the intensity of the calorimetric signal is measured using a spectrophotometer. The five fractions with the strongest signal are considered the elution peak and are combined together. Total protein yield is determined by estimating the total protein concentration of the pooled peak elution fractions using bovine gamma globulin as a standard (Bio-Rad Laboratories, Hercules, Calif.).

For purification of a modified Clostridial toxin using a FPLC desalting column, a HiPrep™ 26/10 size exclusion column (Amersham Biosciences, Piscataway, N.J.) is pre-equilibrated with 80 mL of 4° C. Column Buffer (50 mM sodium phosphate, pH 6.5). After the column is equilibrated, a Clostridial toxin sample is applied to the size exclusion column with an isocratic mobile phase of 4° C. Column Buffer and at a flow rate of 10 mL/minute using a BioLogic DuoFlow chromatography system (Bio-Rad Laboratories, Hercules, Calif.). The desalted modified Clostridial toxin sample is collected as a single fraction of approximately 7-12 mL.

For purification of a modified Clostridial toxin using a FPLC ion exchange column, a Clostridial toxin sample that has been desalted following elution from an IMAC column is applied to a 1 mL Q1™ anion exchange column (Bio-Rad Laboratories, Hercules, Calif.) using a BioLogic DuoFlow chromatography system (Bio-Rad Laboratories, Hercules, Calif.). The sample is applied to the column in 4° C. Column Buffer (50 mM sodium phosphate, pH 6.5) and is eluted by linear gradient with 4° C. Elution Buffer (50 mM sodium phosphate, 1 M sodium chloride, pH 6.5) as follows: step 1, 5.0 mL of 5% Elution Buffer at a flow rate of 1 mL/minute; step 2, 20.0 mL of 5-30% Elution Buffer at a flow rate of 1 mL/minute; step 3, 2.0 mL of 50% Elution Buffer at a flow rate of 1.0 mL/minute; step 4, 4.0 mL of 100% Elution Buffer at a flow rate of 1.0 mL/minute; and step 5, 5.0 mL of 0% Elution Buffer at a flow rate of 1.0 mL/minute. Elution of Clostridial toxin from the column is monitored at 280, 260, and 214 nm, and peaks absorbing above a minimum threshold (0.01 au) at 280 nm are collected. Most of the Clostridial toxin will elute at a sodium chloride concentration of approximately 100 to 200 mM. Average total yields of Clostridial toxin will be determined by a Bradford assay.

Expression of a modified Clostridial toxin is analyzed by polyacrylamide gel electrophoresis. Samples purified using the procedure described above are added to 2×LDS Sample Buffer (Invitrogen, Inc, Carlsbad, Calif.) and are separated by MOPS polyacrylamide gel electrophoresis using NuPAGE® Novex 4-12% Bis-Tris precast polyacrylamide gels (Invitrogen, Inc, Carlsbad, Calif.) under denaturing, reducing conditions. Gels are stained with SYPRO® Ruby (Bio-Rad Laboratories, Hercules, Calif.) and the separated polypeptides are imaged using a Fluor-S MAX Multilmager (Bio-Rad Laboratories, Hercules, Calif.) for quantification of Clostridial toxin expression levels. The size and amount of the Clostridial toxin is determined by comparison to Magic-Mark™ protein molecular weight standards (Invitrogen, Inc, Carlsbad, Calif.).

Expression of modified Clostridial toxin is also analyzed by Western blot analysis. Protein samples purified using the procedure described above are added to 2×LDS Sample Buffer (Invitrogen, Inc, Carlsbad, Calif.) and are separated by MOPS polyacrylamide gel electrophoresis using NuPAGE® Novex 4-12% Bis-Tris precast polyacrylamide gels (Invitrogen, Inc, Carlsbad, Calif.) under denaturing, reducing conditions. Separated polypeptides are transferred from the gel onto polyvinylidene fluoride (PVDF) membranes (Invitrogen, Inc, Carlsbad, Calif.) by Western blotting using a Trans-Blot® SD semi-dry electrophoretic transfer cell apparatus (Bio-Rad Laboratories, Hercules, Calif.). PVDF membranes are blocked by incubating at room temperature for 2 hours in a solution containing 25 mM Tris-Buffered Saline (25 mM 2-amino-2-hydroxymethyl-1,3-propanediol hydrochloric acid (Tris-HCl)(pH 7.4), 137 mM sodium chloride, 2.7 mM potassium chloride), 0.1% TWEEN-20®, polyoxyethylene (20) sorbitan monolaureate, 2% bovine serum albumin, 5% nonfat dry milk. Blocked membranes are incubated at 4° C. for overnight in Tris-Buffered Saline TWEEN-20® (25 mM Tris-Buffered Saline, 0.1% TWEEN-20®, polyoxyethylene (20) sorbitan monolaureate) containing appropriate primary antibodies as a probe. Primary antibody probed blots are washed three times for 15 minutes each time in Tris-Buffered Saline TWEEN-20®. Washed membranes are incubated at room temperature for 2 hours in Tris-Buffered Saline TWEEN-20® containing an appropriate immunoglobulin G antibody conjugated to horseradish peroxidase as a secondary antibody. Secondary antibody-probed blots are washed three times for 15 minutes each time in Tris-Buffered Saline TWEEN-20®. Signal detection of the labeled Clostridial toxin are visualized using the ECL Plus™ Western Blot Detection System (Amersham Biosciences, Piscataway, N.J.) and are imaged with a Typhoon 9410 Variable Mode Imager (Amersham Biosciences, Piscataway, N.J.) for quantification of modified Clostridial toxin expression levels.

Example 6

Expression of Modified Clostridial Toxins in a Yeast Cell

The following example illustrates a procedure useful for expressing any of the modified Clostridial toxins disclosed in the present specification in a yeast cell.

To construct a suitable yeast expression construct encoding a modified Clostridial toxin, restriction endonuclease sites suitable for cloning an operably linked polynucleotide molecule into a pPIC A vector (Invitrogen, Inc, Carlsbad, Calif.) are incorporated into the 5'- and 3' ends of the polynucleotide molecule SEQ ID NO: 136 encoding BoNT/A-ED-PAR1Tb of SEQ ID NO: 85. This polynucleotide molecule is synthesized and a pUCBHB1/BoNT/A-ED-PAR1Tb construct is obtained as described in Example 1. This construct is digested with restriction enzymes that 1) excise the insert containing the open reading frame of SEQ ID NO: 136 encoding BoNT/A-ED-PAR1Tb; and 2) enable this insert to be operably-linked to a pPIC A vector. This insert is subcloned using a T4 DNA ligase procedure into a pPIC A vector that is digested with appropriate restriction endonucleases to yield pPIC A/BoNT/A-ED-PAR1Tb. The ligation mixture is transformed into chemically competent *E. coli* DH5α cells (Invitrogen, Inc, Carlsbad, Calif.) using a heat shock method, plated on 1.5% low salt Luria-Bertani agar plates (pH 7.5) containing 25 µg/mL of Zeocin™, and placed in a 37° C. incubator for overnight growth. Bacteria containing expression constructs are identified as Zeocin™ resistant colonies. Candidate constructs are isolated using an alkaline lysis plasmid mini-preparation procedure and analyzed by restriction endonuclease digest mapping to determine the presence and orientation of the insert. This cloning strategy yielded a pPIC A expression construct comprising the polynucleotide molecule of SEQ ID NO: 136 encoding the BoNT/A-ED-PAR1Tb of SEQ ID NO: 85 operably-linked to a carboxyl-terminal c-myc and polyhistidine binding peptides (FIG. 10).

A similar cloning strategy is used to make pPIC A expression constructs comprising the polynucleotide molecule of SEQ ID NO: 109 encoding BoNT/A-ED-PAR1Tb of SEQ ID NO: 85; SEQ ID NO: 110 or SEQ ID NO: 137 encoding BoNT/A-ED-PAR1Xa of SEQ ID NO: 86; the polynucleotide molecule of SEQ ID NO: 111 or SEQ ID NO: 138 encoding BoNT/A-ED-PAR2Tp of SEQ ID NO: 87; the polynucleotide molecule of SEQ ID NO: 112 or SEQ ID NO: 139 encoding BoNT/A-ED-PAR2Xa of SEQ ID NO: 88; the polynucleotide molecule of SEQ ID NO: 113 or SEQ ID NO: 140 encoding BoNT/A-ED-PAR3Tb of SEQ ID NO: 89; the polynucleotide molecule of SEQ ID NO: 114 or SEQ ID NO: 141 encoding BoNT/A-ED-PAR3Xa of SEQ ID NO: 90; the polynucleotide molecule of SEQ ID NO: 115 or SEQ ID NO: 142 encoding BoNT/A-ED-PAR4Tb of SEQ ID NO: 91; and the polynucleotide molecule of SEQ ID NO: 116 or SEQ ID NO: 143 encoding BoNT/A-ED-PAR4Xa of SEQ ID NO: 92.

A similar cloning strategy is used to make pPIC A expression constructs comprising the polynucleotide molecule of SEQ ID NO: 117 encoding BoNT/A-TD-PAR1Xa of SEQ ID NO: 93; SEQ ID NO: 118 or SEQ ID NO: 145 encoding BoNT/A-TD-PAR1Xa of SEQ ID NO: 94; the polynucleotide molecule of SEQ ID NO: 119 or SEQ ID NO: 146 encoding BoNT/A-TD-PAR2Tp of SEQ ID NO: 95; the polynucleotide molecule of SEQ ID NO: 120 or SEQ ID NO: 147 encoding BoNT/A-TD-PAR2Xa of SEQ ID NO: 96; the polynucleotide molecule of SEQ ID NO: 121 or SEQ ID NO: 148 encoding BoNT/A-TD-PAR1Tb of SEQ ID NO: 97; the polynucleotide molecule of SEQ ID NO: 122 or SEQ ID NO: 149 encoding BoNT/A-TD-PAR3Xa of SEQ ID NO: 98; the polynucleotide molecule of SEQ ID NO: 123 or SEQ ID NO: 150 encoding BoNT/A-TD-PAR4Tb of SEQ ID NO: 99; and the polynucleotide molecule of SEQ ID NO: 124 or SEQ ID NO: 151 encoding BoNT/A-TD-PAR4Xa of SEQ ID NO: 100.

A similar cloning strategy is used to make pPIC A expression constructs comprising the polynucleotide molecule of SEQ ID NO: 125 encoding BoNT/A-BD-PAR1Tb of SEQ ID NO: 101; the polynucleotide molecule of SEQ ID NO: 126 or SEQ ID NO: 153 encoding BoNT/A-BD-PAR1Xa of SEQ ID NO: 102; the polynucleotide molecule of SEQ ID NO: 127 or SEQ ID NO: 154 encoding BoNT/A-BD-PAR2Tp of SEQ ID NO: 103; the polynucleotide molecule of SEQ ID NO: 128 or SEQ ID NO: 155 encoding BoNT/A-BD-PAR2Xa of SEQ ID NO: 104; the polynucleotide molecule of SEQ ID NO: 129 or SEQ ID NO: 156 encoding BoNT/A-BD-PAR3Tb of SEQ ID NO: 105; the polynucleotide molecule of SEQ ID NO: 130 or SEQ ID NO: 157 encoding BoNT/A-BD-PAR3Xa of SEQ ID NO: 106; the polynucleotide molecule of SEQ ID NO: 131 or SEQ ID NO: 158 encoding BoNT/A-BD-PAR4Tb of SEQ ID NO: 107; and the polynucleotide molecule of SEQ ID NO: 132 or SEQ ID NO: 159 encoding BoNT/A-BD-PAR4Xa of SEQ ID NO: 108.

To construct a yeast cell line expressing a modified Clostridial toxin, pPICZ A/BoNT/A-ED-PAR1Tb is digested with a suitable restriction endonuclease (i.e., SacI, PmeI or BstXI) and the resulting linearized expression construct is transformed into an appropriate *P. pastoris* Mut$^S$ strain KM71H using an electroporation method. The transformation mixture is plated on 1.5% YPDS agar plates (pH 7.5) containing 100 µg/mL of Zeocin™ and placed in a 28-30° C. incubator for 1-3 days of growth. Selection of transformants integrating the pPICZ A/BoNT/A-ED-PAR1Tb at the 5' AOX1 locus is determined by colony resistance to Zeocin™. A similar strategy is used to make a cell line containing a pPICZ A expression construct containing SEQ ID NO: 2 used as a control for expression levels. Cell lines integrating a pPICZ A/BoNT/A-ED-PAR1Tb construct is tested for BoNT/A-ED-PAR1Tb expression using a small-scale expression test. Isolated colonies from test cell lines that have integrated pPICZ A/BoNT/A-ED-PAR1Tb are used to inoculate 1.0 L baffled flasks containing 100 mL of MGYH media and grown at about 28-30° C. in a shaker incubator (250 rpm) until the culture reaches an $OD_{600}$=2-6 (approximately 16-18 hours). Cells are harvested by centrifugation (3,000×g at 22° C. for 5 minutes). To induce expression, the cell pellet is resuspended in 15 mL of MMH media and 100% methanol is added to a final concentration of 0.5%. Cultures are grown at about 28-30° C. in a shaker incubator (250 rpm) for six days. Additional 100% methanol is added to the culture every 24 hours to a final concentration of 0.5%. A 1.0 mL test aliquot is taken from the culture every 24 hours starting at time zero and ending at time 144 hours. Cells are harvested from the aliquots by microcentrifugation to pellet the cells and lysed using three freeze-thaw rounds consisting of −80° C. for 5 minutes, then 37° C. for 5 minutes. Lysis samples are added to 2×LDS Sample Buffer (Invitrogen, Inc, Carlsbad, Calif.) and expression from established cell lines is measured by Western blot analysis (as described in Example 5) using either anti-BoNT/A, anti-myc or anti-His antibodies in order to identify lines expressing BoNT/A-ED-PAR1Tb. The *P. pastors* Mut$^S$ KM71H cell line showing the highest expression level of BoNT/A-ED-PAR1Tb is selected for large-scale expression using commercial fermentation procedures. Procedures for large-scale expression are as outlined above except the culture volume is approximately 2.5 L MGYH media grown in a 5 L BioFlo 3000 fermentor and concentrations of all reagents will be proportionally increased for this volume.

BoNT/A-ED-PAR1Tb is purified using the IMAC procedure, as described in Example 5. Expression from each culture is evaluated by a Bradford dye assay, polyacrylamide gel electrophoresis and Western blot analysis (as described in Example 5) in order to determine whether the amounts of BoNT/A-ED-PAR1Tb produced.

Example 7

Expression of Modified Clostridial Toxins in an Insect Cell

The following example illustrates a procedure useful for expressing any of the modified Clostridial toxins disclosed in the present specification in an insect cell.

To construct suitable an insect expression construct encoding a modified Clostridial toxin, restriction endonuclease sites suitable for cloning an operably linked polynucleotide molecule into a pBACgus3 vector (EMD Biosciences-Novagen, Madison, Wis.) are incorporated into the 5'- and 3' ends of the polynucleotide molecule SEQ ID NO: 136 encoding BoNT/A-ED-PAR1Tb of SEQ ID NO: 85. This polynucleotide molecule is synthesized and a pUCBHB1/BoNT/A-ED-PAR1Tb construct is obtained as described in Example 1. This construct is digested with restriction enzymes that 1) excise the insert containing the open reading frame of SEQ ID NO: 136 encoding BoNT/A-ED-PAR1Tb; and 2) enable this insert to be operably-linked to a pBACgus3 vector. This insert is subcloned using a T4 DNA ligase procedure into a pBACgus3 vector that is digested with appropriate restriction endonucleases to yield pBACgus3/BoNT/A-ED-PAR1Tb. The ligation mixture is transformed into chemically competent *E. coli* DH5α cells (Invitrogen, Inc, Carlsbad, Calif.) using a heat shock method, plated on 1.5% Luria-Bertani agar plates (pH 7.0) containing 100 µg/mL of Ampicillin, and placed in a 37° C. incubator for overnight growth. Bacteria containing expression constructs are identified as Ampicillin resistant colonies. Candidate constructs are isolated using an alkaline lysis plasmid mini-preparation procedure and analyzed by restriction endonuclease digest mapping to determine the presence and orientation of the insert. This cloning strategy yielded a pBACgus3 expression construct comprising the polynucleotide molecule of SEQ ID NO: 136 encoding the BoNT/A-ED-PAR1Tb of SEQ ID NO: 85 operably linked to an amino-terminal gp64 signal peptide and a carboxyl-terminal, Thrombin cleavable, polyhistidine affinity binding peptide (FIG. 11).

A similar cloning strategy is used to make pBACgus3 expression constructs comprising the polynucleotide molecule of SEQ ID NO: 109 encoding BoNT/A-ED-PAR1Tb of SEQ ID NO: 85; SEQ ID NO: 110 or SEQ ID NO: 137 encoding BoNT/A-ED-PAR1Xa of SEQ ID NO: 86; the polynucleotide molecule of SEQ ID NO: 111 or SEQ ID NO: 138 encoding BoNT/A-ED-PAR2Tp of SEQ ID NO: 87; the polynucleotide molecule of SEQ ID NO: 112 or SEQ ID NO: 139 encoding BoNT/A-ED-PAR2Xa of SEQ ID NO: 88; the polynucleotide molecule of SEQ ID NO: 113 or SEQ ID NO: 140 encoding BoNT/A-ED-PAR3Tb of SEQ ID NO: 89; the polynucleotide molecule of SEQ ID NO: 114 or SEQ ID NO: 141 encoding BoNT/A-ED-PAR3Xa of SEQ ID NO: 90; the polynucleotide molecule of SEQ ID NO: 115 or SEQ ID NO: 142 encoding BoNT/A-ED-PAR4Tb of SEQ ID NO: 91; and the polynucleotide molecule of SEQ ID NO: 116 or SEQ ID NO: 143 encoding BoNT/A-ED-PAR4Xa of SEQ ID NO: 92.

A similar cloning strategy is used to make pBACgus3 expression constructs comprising the polynucleotide molecule of SEQ ID NO: 117 encoding BoNT/A-TD-PAR1Xa of SEQ ID NO: 93; SEQ ID NO: 118 or SEQ ID NO: 145 encoding BoNT/A-TD-PAR1Xa of SEQ ID NO: 94; the polynucleotide molecule of SEQ ID NO: 119 or SEQ ID NO: 146 encoding BoNT/A-TD-PAR2Tp of SEQ ID NO: 95; the polynucleotide molecule of SEQ ID NO: 120 or SEQ ID NO: 147 encoding BoNT/A-TD-PAR2Xa of SEQ ID NO: 96; the polynucleotide molecule of SEQ ID NO: 121 or SEQ ID NO: 148 encoding BoNT/A-TD-PAR1Tb of SEQ ID NO: 97; the polynucleotide molecule of SEQ ID NO: 122 or SEQ ID NO: 149 encoding BoNT/A-TD-PAR3Xa of SEQ ID NO: 98; the polynucleotide molecule of SEQ ID NO: 123 or SEQ ID NO: 150 encoding BoNT/A-TD-PAR4Tb of SEQ ID NO: 99; and the polynucleotide molecule of SEQ ID NO: 124 or SEQ ID NO: 151 encoding BoNT/A-TD-PAR4Xa of SEQ ID NO: 100.

A similar cloning strategy is used to make pBACgus3 expression constructs comprising the polynucleotide molecule of SEQ ID NO: 125 encoding BoNT/A-BD-PAR1Tb of SEQ ID NO: 101; the polynucleotide molecule of SEQ ID NO: 126 or SEQ ID NO: 153 encoding BoNT/A-BD-PAR1Xa of SEQ ID NO: 102; the polynucleotide molecule of SEQ ID NO: 127 or SEQ ID NO: 154 encoding BoNT/A-BD-PAR2Tp of SEQ ID NO: 103; the polynucleotide molecule of SEQ ID NO: 128 or SEQ ID NO: 155 encoding BoNT/A-BD-PAR2Xa of SEQ ID NO: 104; the polynucleotide molecule of SEQ ID NO: 129 or SEQ ID NO: 156 encoding BoNT/A-BD-PAR3Tb of SEQ ID NO: 105; the polynucleotide molecule of SEQ ID NO: 130 or SEQ ID NO: 157 encoding BoNT/A-BD-PAR3Xa of SEQ ID NO: 106; the polynucleotide molecule of SEQ ID NO: 131 or SEQ ID NO: 158 encoding BoNT/A-BD-PAR4Tb of SEQ ID NO: 107; and the polynucleotide molecule of SEQ ID NO: 132 or SEQ ID NO: 159 encoding BoNT/A-BD-PAR4Xa of SEQ ID NO: 108.

To express a modified Clostridial toxin using a baculoviral expression system, about $2.5 \times 10^6$ Sf9 cells are plated in four 60 mm culture dishes containing 2 mL of BacVector® Insect media (EMD Biosciences-Novagen, Madison, Wis.) and incubated for approximately 20 minutes in a 28° C. incubator. For each transfection, a 50 µL transfection solution is prepared in a 6 mL polystyrene tube by adding 25 µL of BacVector® Insect media containing 100 ng of a pBACgus3 construct encoding a modified Clostridial toxin, such as, e.g., pBACgus3/BoNT/A-ED-PAR1Tb, and 500 ng TlowE transfer plasmid to 25 µL of diluted Insect GeneJuice® containing 5 µL Insect GeneJuice® (EMD Biosciences-Novagen, Madison, Wis.) and 20 µL nuclease-free water and this solution is incubated for approximately 15 minutes. After the 15 minute incubation, add 450 µL BacVector® media to the transfection solution and mix gently. Using this stock transfection solution as the 1/10 dilution make additional transfection solutions of 1/50, 1/250 and 1/1250 dilutions. Add 100 µL of a transfection solution to the Sf9 cells from one of the four 60 mm culture dishes, twice washed with antibiotic-free, serum-free BacVector® Insect media and incubate at 22° C. After one hour, add 6 mL of 1% BacPlaque agarose-BacVector® Insect media containing 5% bovine serum albumin. After the agarose is solidified, add 2 mL BacVector® Insect media containing 5% bovine serum albumin to the transfected cells and transfer the cells to a 28° C. incubator for 3-5 days until plaques are visible. After 3-5 days post-transfection, plaques in the monolayer will be stained for β-glucuronidase reporter gene activity to test for the presence of recombinant virus plaques containing pBACgus3/BoNT/A-ED-PAR1Tb by incubating the washed monolayer with 2 mL of BacVector® Insect media containing 30 µL of 20 mg/mL X-Gluc Solution (EMD Biosciences-Novagen, Madison, Wis.) for approximately 2 hours in a 28° C. incubator.

After identifying candidate recombinant virus plaques, several candidate virus plaques are eluted and plaque purified. To elute a recombinant virus, transfer a plug containing a recombinant virus plaque with a sterile Pasteur pipet to 1 mL BacVector® Insect media (EMD Biosciences-Novagen, Madison, Wis.) in a sterile screw-cap vial. Incubate the vial for approximately 2 hours at 22° C. or for approximately 16 hours at 4° C. For each recombinant virus plaque, $2.5 \times 10^5$ Sf9 cells are plated in 35 mm culture dishes containing 2 mL of BacVector® Insect media (EMD Biosciences-Novagen, Madison, Wis.) and incubated for approximately 20 minutes in a 28° C. incubator. Remove the media and add 200 µL of eluted recombinant virus. After one hour, add 2 mL of 1% BacPlaque agarose-BacVector® Insect media containing 5% bovine serum albumin. After the agarose is solidified, add 1 mL BacVector® Insect media containing 5% bovine serum albumin to the transfected cells and transfer the cells to a 28° C. incubator for 3-5 days until plaques are visible. After 3-5 days post-transfection, plaques in the monolayer will be stained for B-glucuronidase reporter gene activity to test for the presence of recombinant virus plaques containing pBACgus3/BoNT/A-ED-PAR1Tb by incubating the washed monolayer with 2 mL of BacVector® Insect media containing 30 µL of 20 mg/mL X-Gluc Solution (EMD Biosciences-Novagen, Madison, Wis.) for approximately 2 hours in a 28° C. incubator.

To prepare a seed stock of virus, elute a recombinant virus by transferring a plug containing a recombinant virus plaque with a sterile Pasteur pipet to 1 mL BacVector® Insect media (EMD Biosciences-Novagen, Madison, Wis.) in a sterile screw-cap vial. Incubate the vial for approximately 16 hours at 4° C. Approximately $5 \times 10^5$ Sf9 cells are plated in T-25 flask containing 5 mL of BacVector® Insect media (EMD Biosciences-Novagen, Madison, Wis.) and are incubated for approximately 20 minutes in a 28° C. incubator. Remove the media and add 300 µL of eluted recombinant virus. After one hour, add 5 mL BacVector® Insect media containing 5% bovine serum albumin to the transfected cells and transfer the cells to a 28° C. incubator for 3-5 days until the majority of cells become unattached and unhealthy. The virus is harvested by transferring the media to 15 mL snap-cap tubes and centrifuging tubes at 1000×g for 5 minutes to remove debris. The clarified supernatant is transferred to fresh 15 mL snap-cap tubes and are stored at 4° C.

To prepare a high titer stock of virus, approximately $2 \times 10^7$ Sf9 cells are plated in T-75 flask containing 10 mL of BacVector® Insect media (EMD Biosciences-Novagen, Madison, Wis.) and are incubated for approximately 20 minutes in a 28° C. incubator. Remove the media and add 500 µL of virus seed stock. After one hour, add 10 mL BacVector® Insect media containing 5% bovine serum albumin to the transfected cells and transfer the cells to a 28° C. incubator for 3-5 days until the majority of cells become unattached and unhealthy. The virus is harvested by transferring the media to 15 mL snap-cap tubes and centrifuging tubes at 1000×g for 5 minutes to remove debris. The clarified supernatant is transferred to fresh 15 mL snap-cap tubes and are stored at 4° C. High titer virus stocks should contain approximately $2 \times 10^8$ to $3 \times 10^9$ pfu of baculovirus.

To express gp64-BoNT/A-ED-PAR1Tb using a baculoviral expression system, about $1.25 \times 10^8$ Sf9 cells are seeded in a 1 L flask containing 250 mL of BacVector® Insect media and are grown in an orbital shaker (150 rpm) to a cell density of approximately $5 \times 10^8$. The culture is inoculated with approximately $2.5 \times 10^9$ of high titer stock recombinant baculovirus and incubated for approximately 48 hours in a 28° C. orbital shaker (150 rpm). Media is harvested by transferring the media to tubes and centrifuging tubes at 500×g for 5 minutes to remove debris. Media samples are added to 2×LDS Sample Buffer (Invitrogen, Inc, Carlsbad, Calif.) and expression is measured by Western blot analysis (as described in Example 5) using either anti-BoNT/A or anti-His antibodies in order to identify baculoviral stocks expressing BoNT/A-ED-PAR1Tb.

BoNT/A-ED-PAR1Tb is purified using the IMAC procedure, as described in Example 5. Expression from each culture is evaluated by a Bradford dye assay, polyacrylamide gel electrophoresis and Western blot analysis (as described in Example 5) in order to determine whether the amounts of BoNT/A-ED-PAR1Tb produced.

Example 8

Expression of Modified Clostridial Toxins in a Mammalian Cell

The following example illustrates a procedure useful for expressing any of the modified Clostridial toxins disclosed in the present specification in a mammalian cell.

To construct a suitable mammalian expression construct encoding a modified Clostridial toxin, restriction endonuclease sites suitable for cloning an operably linked polynucleotide molecule into a pSecTag2 vector (Invitrogen, Inc, Carlsbad, Calif.) are incorporated into the 5'- and 3' ends of the polynucleotide molecule SEQ ID NO: 136 encoding BoNT/A-ED-PAR1Tb of SEQ ID NO: 85. This polynucleotide molecule is synthesized and a pUCBHB1/BoNT/A-ED-PAR1Tb construct is obtained as described in Example 1. This construct is digested with restriction enzymes that 1) excise the insert containing the open reading frame of SEQ ID NO: 136 encoding BoNT/A-ED-PAR1Tb; and 2) enable this insert to be operably-linked to a pSecTag2 vector. This insert is subcloned using a T4 DNA ligase procedure into a pSecTag2 vector that is digested with appropriate restriction endonucleases to yield pSecTag2/BoNT/A-ED-PAR1Tb. The ligation mixture is transformed into chemically competent E. coli DH5α cells (Invitrogen, Inc, Carlsbad, Calif.) using a heat shock method, plated on 1.5% Luria-Bertani agar plates (pH 7.0) containing 100 μg/mL of Ampicillin, and placed in a 37° C. incubator for overnight growth. Bacteria containing expression constructs are identified as Ampicillin resistant colonies. Candidate constructs are isolated using an alkaline lysis plasmid mini-preparation procedure and analyzed by restriction endonuclease digest mapping to determine the presence and orientation of the insert. This cloning strategy yielded a pSecTag2 expression construct comprising the polynucleotide molecule of SEQ ID NO: 136 encoding the BoNT/A-ED-PAR1Tb of SEQ ID NO: 85 operably-linked to a carboxyl-terminal c-myc and polyhistidine binding peptides (FIG. 12).

A similar cloning strategy is used to make pSecTag2 expression constructs comprising the polynucleotide molecule of SEQ ID NO: 109 encoding BoNT/A-ED-PAR1Tb of SEQ ID NO: 85; SEQ ID NO: 110 or SEQ ID NO: 137 encoding BoNT/A-ED-PAR1Xa of SEQ ID NO: 86; the polynucleotide molecule of SEQ ID NO: 111 or SEQ ID NO: 138 encoding BoNT/A-ED-PAR2Tp of SEQ ID NO: 87; the polynucleotide molecule of SEQ ID NO: 112 or SEQ ID NO: 139 encoding BoNT/A-ED-PAR2Xa of SEQ ID NO: 88; the polynucleotide molecule of SEQ ID NO: 113 or SEQ ID NO: 140 encoding BoNT/A-ED-PAR3Tb of SEQ ID NO: 89; the polynucleotide molecule of SEQ ID NO: 114 or SEQ ID NO: 141 encoding BoNT/A-ED-PAR3Xa of SEQ ID NO: 90; the polynucleotide molecule of SEQ ID NO: 115 or SEQ ID NO: 142 encoding BoNT/A-ED-PAR4Tb of SEQ ID NO: 91; and the polynucleotide molecule of SEQ ID NO: 116 or SEQ ID NO: 143 encoding BoNT/A-ED-PAR4Xa of SEQ ID NO: 92.

A similar cloning strategy is used to make pSecTag2 expression constructs comprising the polynucleotide molecule of SEQ ID NO: 117 encoding BoNT/A-TD-PAR1Xa of SEQ ID NO: 93; SEQ ID NO: 118 or SEQ ID NO: 145 encoding BoNT/A-TD-PAR1Xa of SEQ ID NO: 94; the polynucleotide molecule of SEQ ID NO: 119 or SEQ ID NO: 146 encoding BoNT/A-TD-PAR2Tp of SEQ ID NO: 95; the polynucleotide molecule of SEQ ID NO: 120 or SEQ ID NO: 147 encoding BoNT/A-TD-PAR2Xa of SEQ ID NO: 96; the polynucleotide molecule of SEQ ID NO: 121 or SEQ ID NO: 148 encoding BoNT/A-TD-PAR1Tb of SEQ ID NO: 97; the polynucleotide molecule of SEQ ID NO: 122 or SEQ ID NO: 149 encoding BoNT/A-TD-PAR3Xa of SEQ ID NO: 98; the polynucleotide molecule of SEQ ID NO: 123 or SEQ ID NO: 150 encoding BoNT/A-TD-PAR4Tb of SEQ ID NO: 99; and the polynucleotide molecule of SEQ ID NO: 124 or SEQ ID NO: 151 encoding BoNT/A-TD-PAR4Xa of SEQ ID NO: 100.

A similar cloning strategy is used to make pSecTag2 expression constructs comprising the polynucleotide molecule of SEQ ID NO: 125 encoding BoNT/A-BD-PAR1Tb of SEQ ID NO: 101; the polynucleotide molecule of SEQ ID NO: 126 or SEQ ID NO: 153 encoding BoNT/A-BD-PAR1Xa of SEQ ID NO: 102; the polynucleotide molecule of SEQ ID NO: 127 or SEQ ID NO: 154 encoding BoNT/A-BD-PAR2Tp of SEQ ID NO: 103; the polynucleotide molecule of SEQ ID NO: 128 or SEQ ID NO: 155 encoding BoNT/A-BD-PAR2Xa of SEQ ID NO: 104; the polynucleotide molecule of SEQ ID NO: 129 or SEQ ID NO: 156 encoding BoNT/A-BD-PAR3Tb of SEQ ID NO: 105; the polynucleotide molecule of SEQ ID NO: 130 or SEQ ID NO: 157 encoding BoNT/A-BD-PAR3Xa of SEQ ID NO: 106; the polynucleotide molecule of SEQ ID NO: 131 or SEQ ID NO: 158 encoding BoNT/A-BD-PAR4Tb of SEQ ID NO: 107; and the polynucleotide molecule of SEQ ID NO: 132 or SEQ ID NO: 159 encoding BoNT/A-BD-PAR4Xa of SEQ ID NO: 108.

To transiently express modified Clostridial toxin in a cell line, about $1.5 \times 10^5$ SH-SY5Y cells are plated in a 35 mm tissue culture dish containing 3 mL of complete Dulbecco's Modified Eagle Media (DMEM), supplemented with 10% fetal bovine serum (FBS), 1× penicillin/streptomycin solution (Invitrogen, Inc, Carlsbad, Calif.) and 1×MEM non-essential amino acids solution (Invitrogen, Inc, Carlsbad, Calif.), and grown in a 37° C. incubator under 5% carbon dioxide until cells reach a density of about $5 \times 10^5$ cells/ml (6-16 hours). A 500 μL transfection solution is prepared by adding 250 μL of OPTI-MEM Reduced Serum Medium containing 15 µL of LipofectAmine 2000 (Invitrogen, Carlsbad, Calif.) incubated at room temperature for 5 minutes to 250 µL of OPTI-MEM Reduced Serum Medium containing 5 µg of a pSecTag2 expression construct encoding a modified Clostridial toxin, such as, e.g., pSecTag2/BoNT/A-ED-PAR1Tb. This transfection is incubated at room temperature for approximately 20 minutes. The complete, supplemented DMEM media is replaced with 2 mL of OPTI-MEM Reduced Serum Medium and the 500 µL transfection solution is added to the SH-SY5Y cells and the cells are incubated in a 37° C. incubator under 5% carbon dioxide for approximately 6 to 18 hours. Transfection media is replaced with 3 mL of fresh complete, supplemented DMEM and the cells are incubated in a 37° C. incubator under 5% carbon dioxide for 48 hours. Both media and cells are collected for expression analysis of BoNT/A-ED-PAR1Tb. Media is harvested by transferring the media to 15 mL snap-cap tubes and centrifuging tubes at 500×g for 5 minutes to remove debris. Cells are harvested by rinsing cells once with 3.0 mL of 100 mM phosphate-buffered saline, pH 7.4 and lysing cells with a buffer containing 62.6 mM 2-amino-2-hydroxymethyl-1,3-propanediol hydrochloric acid (Tris-HCl), pH 6.8 and 2% sodium lauryl sulfate (SDS). Both media and cell samples are added to 2×LDS Sample Buffer (Invitrogen, Inc, Carlsbad, Calif.) and expression is measured by Western blot analysis (as described in Example 5) using either anti-BoNT/A, anti-c-myc or anti-His antibodies in order to identify pSecTag2 constructs expressing BoNT/A-ED-PAR1Tb. A similar procedure can be used to transiently express a pSecTag2 construct encoding any of the modified Clostridial toxin of SEQ ID NO: 86 to SEQ ID NO: 108.

To generate a stably-integrated cell line expressing a modified Clostridial toxin, approximately $1.5 \times 10^5$ SH-SY5Y cells are plated in a 35 mm tissue culture dish containing 3 mL of complete DMEM, supplemented with 10% FBS, 1× penicillin/streptomycin solution (Invitrogen, Inc, Carlsbad, Calif.) and 1×MEM non-essential amino acids solution (Invitrogen, Inc, Carlsbad, Calif.), and grown in a 37° C. incubator under 5% carbon dioxide until cells reach a density of about $5 \times 10^5$ cells/ml (6-16 hours). A 500 µL transfection solution is prepared by adding 250 µL of OPTI-MEM Reduced Serum Medium containing 15 µL of LipofectAmine 2000 (Invitrogen, Carlsbad, Calif.) incubated at room temperature for 5 minutes to 250 µL of OPTI-MEM Reduced Serum Medium containing 5 µg of a pSecTag2 expression construct encoding a modified Clostridial toxin, such as, e.g., pSecTag2/BoNT/A-ED-PAR1Tb. This transfection solution is incubated at room temperature for approximately 20 minutes. The complete, supplemented DMEM media is replaced with 2 mL of OPTI-MEM Reduced Serum Medium and the 500 µL transfection solution is added to the SH-SY5Y cells and the cells are incubated in a 37° C. incubator under 5% carbon dioxide for approximately 6 to 18 hours. Transfection media is replaced with 3 mL of fresh complete, supplemented DMEM and cells are incubated in a 37° C. incubator under 5% carbon dioxide for approximately 48 hours. Media is replaced with 3 mL of fresh complete DMEM, containing approximately 5 µg/mL of Zeocin™, 10% FBS, 1× penicillin/streptomycin solution (Invitrogen, Inc, Carlsbad, Calif.) and 1×MEM non-essential amino acids solution (Invitrogen, Inc, Carlsbad, Calif.). Cells are incubated in a 37° C. incubator under 5% carbon dioxide for approximately 3-4 weeks, with old media being replaced with fresh Zeocin™-selective, complete, supplemented DMEM every 4 to 5 days. Once Zeocin™-resistant colonies are established, resistant clones are replated to new 35 mm culture plates containing fresh complete DMEM, supplemented with approximately 5 µg/mL of Zeocin™, 10% FBS, 1× penicillin/streptomycin solution (Invitrogen, Inc, Carlsbad, Calif.) and 1×MEM non-essential amino acids solution (Invitrogen, Inc, Carlsbad, Calif.), until these cells reach a density of 6 to $20 \times 10^5$ cells/mL. To test for expression of BoNT/A-ED-PAR1Tb from SH-SY5Y cell lines that have stably-integrated a pSecTag2/BoNT/A-ED-PAR1Tb, approximately $1.5 \times 10^5$ SH-SY5Y cells from each cell line are plated in a 35 mm tissue culture dish containing 3 mL of Zeocin™-selective, complete, supplemented DMEM and grown in a 37° C. incubator under 5% carbon dioxide until cells reach a density of about $5 \times 10^5$ cells/ml (6-16 hours). Media is replaced with 3 mL of fresh Zeocin™-selective, complete, supplemented DMEM and cells are incubated in a 37° C. incubator under 5% carbon dioxide for 48 hours. Both media and cells are collected for expression analysis of BoNT/A-c-myc-His. Media is harvested by transferring the media to 15 mL snap-cap tubes and centrifuging tubes at 500×g for 5 minutes to remove debris. Cells are harvest by rinsing cells once with 3.0 mL of 100 mM phosphate-buffered saline, pH 7.4 and lysing cells with a buffer containing 62.6 mM 2-amino-2-hydroxymethyl-1,3-propanediol hydrochloric acid (Tris-HCl), pH 6.8 and 2% sodium lauryl sulfate (SDS). Both media and cell samples are added to 2×LDS Sample Buffer (Invitrogen, Inc, Carlsbad, Calif.) and expression is measured by Western blot analysis (as described in Example 5) using either anti-BoNT/A, anti-c-myc or anti-His antibodies in order to identify SH-SY5Y cell lines expressing BoNT/A-ED-PAR1Tb. The established SH-SY5Y cell line showing the highest expression level of BoNT/A-ED-PAR1Tb is selected for large-scale expression using 3 L flasks. Procedures for large-scale expression are as outlined above except the starting volume is approximately 800-1000 mL of complete DMEM and concentrations of all reagents are proportionally increased for this volume. A similar procedure can be used to stably express a pSecTag2 construct encoding any of the modified Clostridial toxin of SEQ ID NO: 86 to SEQ ID NO: 108.

BoNT/A-ED-PAR1Tb is purified using the IMAC procedure, as described in Example 5. Expression from each culture is evaluated by a Bradford dye assay, polyacrylamide gel electrophoresis and Western blot analysis (as described in Example 5) in order to determine whether the amounts of BoNT/A-ED-PAR1Tb produced.

Although aspects of the present invention have been described with reference to the disclosed embodiments, one skilled in the art will readily appreciate that the specific examples disclosed are only illustrative of these aspects and in no way limit the present invention. Various modifications can be made without departing from the spirit of the present invention.

SEQUENCE LISTING (160 sequences)

SEQ ID NO: 1 - protein, 1296 aa, Clostridium botulinum Serotype A
  DOMAIN (1)...(448): Light chain comprising the enzymatic domain.
  DOMAIN (449)...(860): Amino-terminal half of heavy chain comprising the translocation domain.
  DOMAIN (861)...(1296): Carboxyl-terminal half of heavy chain comprising the binding domain.
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 2 - protein, 1291 aa, Clostridium botulinum Serotype B
  DOMAIN (1)...(441): Light chain comprising the enzymatic domain.
  DOMAIN (442)...(847): Amino-terminal half of heavy chain comprising the translocation domain.
  DOMAIN (848)...(1291): Carboxyl-terminal half of heavy chain comprising the binding domain.
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 3 - protein, 1291 aa, Clostridium botulinum Serotype C1
  DOMAIN (1)...(449): Light chain comprising the enzymatic domain.
  DOMAIN (450)...(855): Amino-terminal half of heavy chain comprising the translocation domain.
  DOMAIN (856)...(1291): Carboxyl-terminal half of heavy chain comprising the binding domain.
MPITINNFNYSDPVDNKNILYLDTHLNTLANEPEKAFRITGNIWVIPDRFSRNSNPNLNKPPRVTSPKSGYYDPNYLSTDSDKDPFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNNINDSKILSLQNRKNTLVDTSGYNAEVSEEGDVQLNPIFPFDFKLGSSGEDRGKVIVTQNENIVYNSMYESFSISFWIRINKWVSNLPGYTIIDSVKNNSGWSIGIISNFLVFTLKQNEDSEQSINFSYDISNNAPGYNKWFFVTVTNNMMGNMKIYINGKLIDTIKVKELTGINFSKTITFEINKIPDTGLITSDSDNINMWIRDFYIFAKELDGKDINILFNSLQYTNVVKDYWGNDLRYNKEYYMVNIDYLNRYMYANSRQIVFNTRRNNNDFNEGYKIIIKRIRGNTNDTRVRGGDILYFDMTINNKAYNLFMKNETMYADNHSTEDIYAIGLREQTKDINDNIIFQIQPMNNTYYYASQIFKSNFNGENISGICSIGTYRFRLGGDWYRHNYLVPTVKQGNYASLLESTSTHWGFVPVSE

SEQ ID NO: 4 - protein, 1276 aa, Clostridium botulinum Serotype D
  DOMAIN (1)...(442): Light chain comprising the enzymatic domain.
  DOMAIN (443)...(851): Amino-terminal half of heavy chain comprising the translocation domain.
  DOMAIN (852)...(1276): Carboxyl-terminal half of heavy chain comprising the binding domain.
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCLRLTKNSRDDSTCIKVKNNRLPYVADKDSISQEIFENKIITDETNVQNYSDKFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFNQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNSINDSKILSLQNKKNALVDTSGYNAEVRVGDNVQLNTIYTNDFKLSSSGDKIIVNLNNNILYSAIYENSSVSFWIKISKDLTNSHNEYTIINSIEQNSGWKLCIRNGNIEWILQDVNRKYKSLIFDYSESLSHTGYTNKWFFVTITNNIMGYMKLYINGELKQSQKIEDLDEVKLDKTIVFGIDENIDENQMLWIRDFNIFSKELSNEDINIVYEGQILRNVIKDYWGNPLKFDTEYYIINDNYIDRYIAPESNVLVLVQYPDRSKLYTGNPITIKSVSDKNPYSRILNGDNIILHMLYNSRKYMIIRDTDTIYATQGGECSQNCVYALKLQSNLGNYGIGIFSIKNIVSKNKYCSQIFSSFRENTMLLADIYKPWRFSFKNAYTPVAVTNYETKLLSTSSFWKFISRDPGWVE

SEQ ID NO: 5 - protein, 1252 aa, Clostridium botulinum Serotype E
  DOMAIN (1)...(422): Light chain comprising the enzymatic domain.
  DOMAIN (423)...(834): Amino-terminal half of heavy chain comprising the translocation domain.
  DOMAIN (835)...(1252): Carboxyl-terminal half of heavy chain comprising the binding domain.
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQDILLPNVIIMGAEPDLFETNSSNISLRNNYMPSNHGFGSIAIVTFSPEYSFRFNDNSMNEFIQDPALTLMHELIHSLHGLYGAKGITTKYTITQKQNPLITNIRGTNIEEFLTFGGTDLNIITSAQSNDIYTNLLADYKKIASKLSKVQVSNPLLNPYKDVFEAKYGLDKDASGIYSVNINKFNDIFKKLYSFTEFDLATKFQVKCRQTYIGQYKYFKLSNLLNDSIYNISEGYNINNLKVNFRGQNANLNPRIITPITGRGLVKKIIRFCKNIVSVKGIRKSICIEINNGELFFVASENSYNDDNINTPKEIDDTVTSNNNYENDLDQVILNFNSESAPGLSDEKLNLTIQNDAYIPKYDSNGTSDIEQHDVNELNVFFYLDAQKVPEGENNVNLTSSIDTALLEQPKIYTFFSSEFINNVNKPVQAALFVSWIQQVLVDFTTEANQKSTVDKIADISIVVPYIGLALNIGNEAQKGNFKDALELLGAGILLEFEPELLIPTILVFTIKSFLGSSDNKNKVIKAINNALKERDEKWKEVYSFIVSNWMTKINTQFNKRKEQMYQALQNQVNAIKTIIESKYNSYTLEEKNELTNKYDIKQIENELNQKVSIAMNNIDRFLTESSISYLMKLINEVKINKLREYDENVKTYLLNYIIQHGSILGESQQELNSMVTDTLNNSIPFKLSSYTDDKILISYFNKFFKRIKSSSVLNMRYKNDKYVDTSGYDSNININGDVYKYPTNKNQFGIYNDKLSEVNISQNDYIIYDNKYKNFSISFWVRIPNYDNKIVNVNNEYTIINCMRDNNSGWKVSLNHNEIIWTLQDNAGINQKLAFNYGNANGISDYINKWIFVTITNDRLGDSKLYINGNLIDQKSILNLGNIHVSDNILFKIVNCSYTRYIGIRYFNIFDKELDETEIQTLYSNEPNTNILKDFWGNYLLYDKEYYLLNVLKPNNFIDRRKDSTLSINNIRSTILLANRLYSGIKVKIQRVNNSSTNDNLVRKNDQVYINFVASKTHLFPLYADTATTNKEKTIKISSSGNRFNQVVVMNSVGNNCTMNFKNNNGNNIGLLGFKADTVVASTWYYTHMRDHTNSNGCFWNFISEEHGWQEK

SEQ ID NO: 6 - protein, 1274 aa, Clostridium botulinum Serotype F
  DOMAIN (1)...(436): Light chain comprising the enzymatic domain.
  DOMAIN (437)...(852): Amino-terminal half of heavy chain comprising the translocation domain.
  DOMAIN (853)...(1274): Carboxyl-terminal half of heavy chain comprising the binding domain.
MPVAINSFNYNDPVNDDTILYMQIPYEEKSKKYYKAFEIMRNVWIIPERNTIGTNPSDFDPPASLKNGSSAYYDPNYLTTDAEKDRYLKTTIKLFKRINSNPAGKVLLQEISYAKPYLGNDHTPIDEFSPVTRTTSVNIKLSTNVESSMLLNLLVLGAGPDIFESCCYPVRKLIDPDVVYDPSNYGFGSINIVTFSPEYEYTFNDISGGHNSSTESFIADPAISLAHELIHALHGLYGARGVTYEETIEVKQAPLMIAEKPIRLEEFLTFGGQDLNIITSAMKEKIYNNLLANYEKIATRLSEVNSAPPEYDINEYKDYFQWKYGLDKNADGSYTVNENKFNEIYKKLYSFTESDLANKFKVKCRNTYFIKYEFLKVPNLLDDDIYTVSEGFNIGNLAVNNRGQSIKLNPKIIDSIPDKGLVEKIVKFCKSVIPRKGTKAPPRLCIRVNNSELFFVASESSYNENDINTPKEIDDTTNLNNNYRNNLDEVILDYNSQTIPQISNRTLNTLVQDNSYVPRYDSNGTSEIEEYDVVDFNVFFYLHAQKVPEGETNISLTSSIDTALLEESKDIFFSSEFIDTINKPVNAALFIDWISKVIRDFTTEATQKSTVDKIADISLIVPYVGLALNIIIEAEKGNFEEAFELLGVGILLEFVPELTIPVILVFTIKSYIDSYENKNKAIKAINNSLIEREAKWKEIYSWIVSNWLTRINTQFNKRKEQMYQALQNQVDAIKTAIEYKYNNYTSDEKNRLESEYNINNIEEELNKKVSLAMKNIERFMTESSISYLMKLINEAKVGKLKKYDNHVKSDLLNYILDHRSILGEQTNELSDLVTSTLNSSIPFELSSYTNDKILIIYFNRLYKKIKDSSILDMRYENNKFIDISGYGSNISINGNVYIYSTNRNQFGIYNSRLSEVNIAQNNDIIYNSRYQNFSISFWVRIPKHYKPMNHNREYTIINCMGNNNSGWKISLRTVRDCEIIWTLQDTSGNKENLIFRYEELNRISNYINKWIFVTITNNRLGNSRIYINGNLIVEKSISNLGDIHVSDNILFKIVGCDDETYVGIRYFKVFNTELDKTEIETLYSNEPDPSILKNYWGNYLLYNKKYYLFNLLRKDKYITLNSGILNINQQRGVTEGSVFLNYKLYEGVEVIIRKNGPIDISNTDNFVRKNDLAYINVVDRGVEYRLYADTKSEKEKIIRTSNLNDSLGQIIVMDSIGNNCTMNFQNNNGSNIGLLGFHSNNLVASSWYYNNIRRNTSSNGCFWSSISKENGWKE

SEQ ID NO: 7 - protein, 1297 aa, Clostridium botulinum Serotype G
  DOMAIN (1)...(442): Light chain comprising the enzymatic domain.
  DOMAIN (443)...(852): Amino-terminal half of heavy chain comprising the translocation domain.
  DOMAIN (853)...(1297): Carboxyl-terminal half of heavy chain comprising the binding domain.
MPVNIKNFNYNDPINNDDIIMMEPFNDPGPGTYYKAFRIIDRIWIVPERFTYGFQPDQFNASTGVFSKDVYEYYDPTYLKTDAEKDKFLKTMIKLFNRINSKPSGQRLLDMIVDAIPYLGNASTPPDKFAANVANVSINKKIIQPGAEDQIKGLMTNLIIFGPGPVLSDNFTDSMIMNGHSPISEGFGARMMIRFCPSCLNVFNNVQENKDTSIFSRRAYFADPALTLMHELIHVLHGLYGIKISNLPITPNTKEFFMQHSDPVQAEELYTFGGHDPSVISPSTDMNIYNKALQNFQDIANRLNIVSSAQGSGIDISLYKQIYKNKYDFVEDPNGKYSVDKDKFDKLYKALMFGFTETNLAGEYGIKTRYSYFSEYLPPIKTEKLLDNTIYTQNEGFNIASKNLKTEFNGQNKAVNKEAYEEISLEHLVIYRIAMCKPVMYKNTGKSEQCIIVNNEDLFFIANKDSFSKDLAKAETIAYNTQNNTIENNFSIDQLILDNDLSSGIDLPNENTEPFTNFDDIDIPVYIKQSALKKIFVDGDSLFEYLHAQTFPSNIENLQLTNSLNDALRNNNKVYTFFSTNLVEKANTVVGASLFVNWVKGVIDDFTSESTQKSTIDKVSDVSIIIPYIGPALNVGNETAKENFKNAFEIGGAAILMEFIPELIVPIVGFFTLESYVGNKGHIIMTISNALKKRDQKWTDMYGLIVSQWLSTVNTQFYTIKERMYNALNNQSQAIEKIIEDQYNRYSEEDKMNINIDFNDIDFKLNQSINLAINNIDDFINQCSISYLMNRMIPLAVKKLKDFDDNLKRDLLEYIDTNELYLLDEVNILKSKVNRHLKDSIPFDLSLYTKDTILIQVFNNYISNISSNAILSLSYRGGRLIDSSGYGATMNVGSDVIFNDIGNGQFKLNNSENSNITAHQSKFVVYDSMFDNFSINFWVRTPKYNNNDIQTYLQNEYTIISCIKNDSGWKVSIKGNRIIWTLIDVNAKSKSIFFEYSIKDNISDYINKWFSITITNDRLGNANIYINGSLKKSEKILNLDRINSSNDIDFKLINCTDTTKFVWIKDFNIFGRELNATEVSSLYWIQSSTNTLKDFWGNPLRYDTQYYLFNQGMQNIYIKYFSKASMGETAPRTNFNNAAINYQNLYLGLRFIIKKASNSRNINNDNIVREGDYIYLNIDNISDESYRVYVLVNSKEIQTQLFLAPINDDPTFYDVLQIKKYYEKTTYNCQILCEKDTKTFGLFGIGKFVKDYGYVWDTYDNYFCISQWYLRRISENINKLRLGCNWQFIPVDEGWTE

SEQ ID NO: 8 - protein, 1315 aa, Clostridium tetani
  DOMAIN (1)...(441): Light chain comprising the enzymatic domain.
  DOMAIN (442)...(870): Amino-terminal half of heavy chain comprising the translocation domain.
  DOMAIN (871)...(1315): Carboxyl-terminal half of heavy chain comprising the binding domain.
MPITINNFRYSDPVNNDTIIMMEPPYCKGLDIYYKAFKITDRIWIVPERYEFGTKPEDFNPPSSLIEGASEYYDPNYLRTDSDKDRFLQTMVKLFNRIKNNVAGEALLDKIINAIPYLGNSYSLLDKFDTNSNSVSFNLLEQDPSGATTKSAMLTNLIIFGPGPVLNKNEVRGIVLRVDNKNYFPCRDGFGSIMQMAFCPEYVPTFDNVIENITSLTIGKSKYFQDPALLLMHELIHVLHGLYGMQVSSHEIIPSKQEIYMQHTYPISAEELFTFGGQDANLISIDIKNDLYEKTLNDYKAIANKLSQVTSCNDPNIDIDSYKQIYQQKYQFDKDSNGQYIVNEDKFQILYNSIMYGFTEIELGKKFNIKTRLSYFSMNHDPVKIPNLLDDTIYNDTEGFNIESKDLKSEYKGQNMRVNTNAFRNVDGSGLVSKLIGLCKKIIPPTNIRENLYNRTASLTDLGGELCIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 9 - protein, 425 aa, Homo sapiens
  PEPTIDE (1)...(425): PAR1
MGPRRLLLVAACFSLCGPLLSARTRARRPESKATNATLDPRSFLLRNPNDKYEPFWEDEEKNESGLTEYRLVSINKSSPLQKQLPAFISEDASGYLTSSWLTLFVPSVYTGVFVVSLPLNIMAIVVFILKMKVKKPAVVYMLHLATADVLFVSVLPFKISYYFSGSDWQFGSELCRFVTAAFYCNMYASILLMTVISIDRFLAVVYPMQSLSWRTLGRASFTCLAIWALAIAGVVPLLLKEQTIQVPGLNITTCHDVLNETLLEGYYAYYFSAFSAVFFFVPLIISTVCYVSIIRCLSSSAVANRSKKSRALFLSAAVFCIFIICFGPTNVLLIAHYSFLSHTSTTEAAYFAYLLCVCVSSISCCIDPLIYYYASSECQRYVYSILCCKESSDPSSYNSSGQLMASKMDTCSSNLNNSIYKKLLT

SEQ ID NO: 10 - protein, 397 aa, Homo sapiens
  PEPTIDE (1)...(397): PAR2
MRSPSAAWLLGAAILLAASLSCSGTIQGTNRSSKGRSLIGKVDGTSHVTGKGVTVETVFSVDEFSASVLTGKLTTVFLPIVYTIVFVVGLPSNGMALWVFLFRTKKKHPAVIYMANLALADLLSVIWFPLKIAYHIHGNNWIYGEALCNVLIGFFYGNMYCSILFMTCLSVQRYWVIVNPMGHSRKKANIAIGISLAIWLLILLVTIPLYVVKQTIFIPALNITTCHDVLPEQLLVGDMFNYFLSLAIGVFLFPAFLTASAYVLMIRMLRSSAMDENSEKKRKRAIKLIVTVLAMYLICFTPSNLLLVVHYFLIKSQGQSHVYALYIVALCLSTLNSCIDPFVYYFVSHDFRDHAKNALLCRSVRTVKQMQVSLTSKKHSRKSSSYSSSSTTVKTSY

SEQ ID NO: 11 - protein, 374 aa, Homo sapiens
  PEPTIDE (1)...(374): PAR3
MKALIFAAAGLLLLLPTFCQSGMENDTNNLAKPTLPIKTFRGAPPNSFEEFPFSALEGWTGATITVKIKCPEESASHLHVKNATMGYLTSSLSTKLIPAIYLLVFVVGVPANAVTLWMLFFRTRSICTTVFYTNLAIADFLFCVTLPFKIAYHLNGNNWVFGEVLCRATTVIFYGNMYCSILLLACISINRYLAIVHPFTYRGLPKHTYALVTCGLVWATVFLYMLPFFILKQEYYLVQPDITTCHDVHNTCESSSPFQLYYFISLAFFGFLIPFVLIIYCYAAIIRTLNAYDHRWLWYVKASLLILVIFTICFAPSNIILIIHHANYYYNNTDGLYFIYLIALCLGSLNSCLDPFLYFLMSKTRNHSTAYLTK

SEQ ID NO: 12 - protein, 385 aa, Homo sapiens
  PEPTIDE (1)...(385): PAR4
MWGRLLLWPLVLGFSLSGGTQTPSVYDESGSTGGGDDSTPSILPAPRGYPGQVCANDSDTLELPDSSRALLLGWVPTRLVPALYGLVLVVGLPANGLALWVLATQAPRLPSTMLLMNLATADLLLALALPPRIAYHLRGQRWPFGEAACRLATAALYGHMYGSVLLLAAVSLDRYLALVHPLRARALRGRRLALGLCMAAWLMAAALALPLTLQRQTFRLARSDRVLCHDALPLDAQASHWQPAFTCLALLGCFLPLLAMLLCYGATLHTLAASGRRYGHALRLTAVVLASAVAFFVPSNLLLLLHYSDPSPSAWGNLYGAYVPSLALSTLNSCVDPFIYYYVSAEFRDKVRAGLFQRSPGDTVASKASAEGGSRGMGTHSSLLQ

SEQ ID NO: 13 - protein, 6 aa, Artificial Sequence
  PEPTIDE (1)...(6): Hexapeptide comprising the tethered ligand of PAR1
SFFLRN

SEQ ID NO: 14 - protein, 6 aa, Artificial Sequence
  PEPTIDE (1)...(6): Variant of hexapeptide comprising the tethered ligand of PAR1
SFFLRN

SEQ ID NO: 15 - protein, 6 aa, Artificial Sequence
  PEPTIDE (1)...(6): Variant of hexapeptide comprising the tethered ligand of PAR1
TFLLRN

SEQ ID NO: 16 - protein, 6 aa, Artificial Sequence
  PEPTIDE (1)...(6): Variant of hexapeptide comprising the tethered ligand of PAR1
GFPGKF

SEQ ID NO: 17 - protein, 6 aa, Artificial Sequence
  PEPTIDE (1)...(6): Variant of hexapeptide comprising the tethered ligand of PAR1
GYPAKF

SEQ ID NO: 18 - protein, 6 aa, Artificial Sequence
  PEPTIDE (1)...(6): Variant of hexapeptide comprising the tethered ligand of PAR1
GYPLKF

SEQ ID NO: 19 - protein, 6 aa, Artificial Sequence
  PEPTIDE (1)...(6): Variant of hexapeptide comprising the tethered ligand of PAR1
GYPIKF

SEQ ID NO: 20 - protein, 6 aa, Artificial Sequence
  PEPTIDE (1)...(6): Variant of hexapeptide comprising the tethered ligand of PAR1
  MOD_RES (2)...(2): Xaa is parafluoro-phenylalanine (F).
GXPGKF

SEQ ID NO: 21 - protein, 6 aa, Artificial Sequence
  PEPTIDE (1)...(6): Variant of hexapeptide comprising the tethered ligand of PAR1
  MOD_RES (4)...(4): Xaa is cyclohexylalanine (Cha).
GYPXKF

SEQ ID NO: 22 - protein, 6 aa, Artificial Sequence
  PEPTIDE (1)...(6): Variant of hexapeptide comprising the tethered ligand of PAR1
  MOD_RES (2)...(2): Xaa is parafluoro-phenylalanine (F).
  MOD_RES (3)...(3): Xaa is cyclohexylalanine (Cha).
  MOD_RES (4)...(4): Xaa is cyclohexylalanine (Cha).
SXXXRK

SEQ ID NO: 23 - protein, 6 aa, Artificial Sequence
  PEPTIDE (1)...(6): Variant of hexapeptide comprising the tethered ligand of PAR1
  MOD_RES (2)...(2): Xaa is parafluoro-phenylalanine (F).
  MOD_RES (3)...(3): Xaa is cyclohexylalanine (Cha).
  MOD_RES (4)...(4): Xaa is cyclohexylalanine (Cha).
  MOD_RES (5)...(5): Xaa is homoarginine (homoR).
SXXXXK

SEQ ID NO: 24 - protein, 6 aa, Artificial Sequence
  PEPTIDE (1)...(6): Hexapeptide comprising the tethered ligand of PAR2
SLIGKV

SEQ ID NO: 25 - protein, 6 aa, Artificial Sequence
  PEPTIDE (1)...(6): Variant of hexapeptide comprising the tethered ligand of PAR2
SLIGRL

SEQ ID NO: 26 - protein, 6 aa, Artificial Sequence
  PEPTIDE (1)...(6): Hexapeptide comprising the tethered ligand of PAR3
TFRGAP

SEQ ID NO: 27 - protein, 6 aa, Artificial Sequence
  PEPTIDE (1)...(6): Variant of hexapeptide comprising the tethered ligand of PAR3
SFNGGP

SEQ ID NO: 28 - protein, 6 aa, Artificial Sequence
  PEPTIDE (1)...(6): Hexapeptide comprising the tethered ligand of PAR4
GYPGQV

SEQ ID NO: 29 - protein, 6 aa, Artificial Sequence
  PEPTIDE (1)...(6): Variant of hexapeptide comprising the tethered ligand of PAR4
AYPGKF

SEQ ID NO: 30 - protein, 6 aa, Artificial Sequence
  PEPTIDE (1)...(6): Variant of hexapeptide comprising the tethered ligand of PAR4
TYPGKF

SEQ ID NO: 31 - protein, 6 aa, Artificial Sequence
  PEPTIDE (1)...(6): Variant of hexapeptide comprising the tethered ligand of PAR4
GYPGKY

SEQ ID NO: 32 - protein, 6 aa, Artificial Sequence
  PEPTIDE (1)...(6): Variant of hexapeptide comprising the tethered ligand of PAR4
GYPGKW

SEQ ID NO: 33 - protein, 6 aa, Artificial Sequence
  PEPTIDE (1)...(6): Variant of hexapeptide comprising the tethered ligand of PAR4
GYPGKK

SEQ ID NO: 34 - protein, 6 aa, Artificial Sequence
  PEPTIDE (1)...(6): Variant of hexapeptide comprising the tethered ligand of PAR4
GYPGKF

SEQ ID NO: 35 - protein, 6 aa, Artificial Sequence
  PEPTIDE (1)...(6): Variant of hexapeptide comprising the tethered ligand of PAR4
GYPGRF

SEQ ID NO: 36 - protein, 6 aa, Artificial Sequence
  PEPTIDE (1)...(6): Variant of hexapeptide comprising the tethered ligand of PAR4
GYPGFK

SEQ ID NO: 37 - protein, 6 aa, Artificial Sequence
  PEPTIDE (1)...(6): Variant of hexapeptide comprising the tethered ligand of PAR4
GYPAKF

SEQ ID NO: 38 - protein, 6 aa, Artificial Sequence
  PEPTIDE (1)...(6): Variant of hexapeptide comprising the tethered ligand of PAR4
GFPGKF

SEQ ID NO: 39 - protein, 6 aa, Artificial Sequence
  PEPTIDE (1)...(6): Variant of hexapeptide comprising the tethered ligand of PAR4
GFPGKP

SEQ ID NO: 40 - protein, 6 aa, Artificial Sequence
  PEPTIDE (1)...(6): Variant of hexapeptide comprising the tethered ligand of PAR4
SYPGKF

SEQ ID NO: 41 - protein, 6 aa, Artificial Sequence
  PEPTIDE (1)...(6): Variant of hexapeptide comprising the tethered ligand of PAR4
SYPAKF

SEQ ID NO: 42 - protein, 6 aa, Artificial Sequence
  PEPTIDE (1)...(6): Variant of hexapeptide comprising the tethered ligand of PAR4
SYPGRF

SEQ ID NO: 43 - protein, 6 aa, Artificial Sequence
  PEPTIDE (1)...(6): Variant of hexapeptide comprising the tethered ligand of PAR4
SYAGKF

SEQ ID NO: 44 - protein, 6 aa, Artificial Sequence
  PEPTIDE (1)...(6): Variant of hexapeptide comprising the tethered ligand of PAR4
  MOD_RES (5)...(5): Xaa is ornithine (Orn).
GYPGXF

SEQ ID NO: 45 - protein, 6 aa, Artificial Sequence
  PEPTIDE (1)...(6): Variant of hexapeptide comprising the tethered ligand of PAR4
  MOD_RES (2)...(2): Xaa is parafluoro-phenylalanine (F).
GXPGKF

SEQ ID NO: 46 - protein, 6 aa, Artificial Sequence
  PEPTIDE (1)...(6): Variant of hexapeptide comprising the tethered ligand of PAR4
  MOD_RES (5)...(5): Xaa is homoarginine (homoR).
GYPGXF

SEQ ID NO: 47 - protein, 6 aa, Artificial Sequence
  PEPTIDE (1)...(6): Variant of hexapeptide comprising the tethered ligand of PAR4
  MOD_RES (5)...(5): Xaa is homoarginine (homoR).
SYPGXF

SEQ ID NO: 48 - protein, 5 aa, Artificial Sequence
  PEPTIDE (1)...(5): Flexible peptide spacer
GGGGS

SEQ ID NO: 49 - protein, 5 aa, Artificial Sequence
  PEPTIDE (1)...(5): Flexible peptide spacer
EAAAK

SEQ ID NO: 50 - protein, 5 aa, Artificial Sequence
  SITE (1)...(5): Bovine enterokinase protease cleavage site.
DDDDK

SEQ ID NO: 51 - protein, 7 aa, Artificial Sequence
  SITE (1)...(7): Tobacco Etch Virus protease cleavage site.
ENLYFQG

SEQ ID NO: 52 - protein, 7 aa, Artificial Sequence
  SITE (1)...(7): Tobacco Etch Virus protease cleavage site.
ENLYFQS

SEQ ID NO: 53 - protein, 7 aa, Artificial Sequence
  SITE (1)...(7): Tobacco Etch Virus protease cleavage site.
ENIYTQG

SEQ ID NO: 54 - protein, 7 aa, Artificial Sequence
  SITE (1)...(7): Tobacco Etch Virus protease cleavage site.
ENIYTQS

SEQ ID NO: 55 - protein, 7 aa, Artificial Sequence
  SITE (1)...(7): Tobacco Etch Virus protease cleavage site.
ENIYLQG

SEQ ID NO: 56 - protein, 7 aa, Artificial Sequence
  SITE (1)...(7): Tobacco Etch Virus protease cleavage site.
ENIYLQS

SEQ ID NO: 57 - protein, 7 aa, Artificial Sequence
  SITE (1)...(7): Tobacco Etch Virus protease cleavage site.
ENVYFQG

SEQ ID NO: 58 - protein, 7 aa, Artificial Sequence
  SITE (1)...(7): Tobacco Etch Virus protease cleavage site.
ENVYSQS

SEQ ID NO: 59 - protein, 7 aa, Artificial Sequence
  SITE (1)...(7): Tobacco Etch Virus protease cleavage site.
ENVYSQG

SEQ ID NO: 60 - protein, 7 aa, Artificial Sequence
  SITE (0)...(0): Tobacco Etch Virus protease cleavage site.
ENVYSQS

SEQ ID NO: 61 - protein, 7 aa, Artificial Sequence
  SITE (1)...(7): Human Rhinovirus 3C protease cleavage site.
EALFQGP

SEQ ID NO: 62 - protein, 7 aa, Artificial Sequence
  SITE (1)...(7): Human Rhinovirus 3C protease cleavage site.
EVLFQGP

SEQ ID NO: 63 - protein, 7 aa, Artificial Sequence
  SITE (1)...(7): Human Rhinovirus 3C protease cleavage site.
ELLFQGP

SEQ ID NO: 64 - protein, 7 aa, Artificial Sequence
  SITE (1)...(7): Human Rhinovirus 3C protease cleavage site.
DALFQGP

SEQ ID NO: 65 - protein, 7 aa, Artificial Sequence
  SITE (1)...(7): Human Rhinovirus 3C protease cleavage site.
DVLFQGP

SEQ ID NO: 66 - protein, 7 aa, Artificial Sequence
  SITE (0)...(0): Human Rhinovirus 3C protease cleavage site.
DLLFQGP

SEQ ID NO: 67 - protein, 98 aa, Artificial Sequence
  SITE (1)...(98): SUMO/ULP-1 protease cleavage site.
MADSEVNQEAKPEVKPEVKPETHINLKVSDGSSEIFFKIKKTTPLRRLMEAFAKRQGKEMDSLRFLYDGIRIQADQTPEDLDMEDNDIIEAHREQIGG

SEQ ID NO: 68 - protein, 4 aa, Artificial Sequence
  SITE (1)...(4): Thrombin protease cleavage site.
GVRG

SEQ ID NO: 69 - protein, 4 aa, Artificial Sequence
  SITE (1)...(4): Thrombin protease cleavage site.
SARG

SEQ ID NO: 70 - protein, 4 aa, Artificial Sequence
  SITE (1)...(4): Thrombin protease cleavage site.
SLRG

SEQ ID NO: 71 - protein, 4 aa, Artificial Sequence
  SITE (1)...(4): Thrombin protease cleavage site.
DGRI

SEQ ID NO: 72 - protein, 4 aa, Artificial Sequence
  SITE (1)...(4): Thrombin protease cleavage site.
QGKI

SEQ ID NO: 73 - protein, 6 aa, Artificial Sequence
  SITE (1)...(6): Thrombin protease cleavage site.
LVPRGS

SEQ ID NO: 74 - protein, 6 aa, Artificial Sequence
  SITE (1)...(6): Thrombin protease cleavage site.
LVPKGS

SEQ ID NO: 75 - protein, 6 aa, Artificial Sequence
  SITE (1)...(6): Thrombin protease cleavage site.
FIPRTF

SEQ ID NO: 76 - protein, 6 aa, Artificial Sequence
  SITE (1)...(6): Thrombin protease cleavage site.
VLPRSF

SEQ ID NO: 77 - protein, 6 aa, Artificial Sequence
  SITE (1)...(6): Thrombin protease cleavage site.
IVPRSF

SEQ ID NO: 78 - protein, 6 aa, Artificial Sequence
  SITE (1)...(6): Thrombin protease cleavage site.
IVPRGY

SEQ ID NO: 79 - protein, 6 aa, Artificial Sequence
  SITE (1)...(6): Thrombin protease cleavage site.
VVPRGV

SEQ ID NO: 80 - protein, 6 aa, Artificial Sequence
  SITE (1)...(6): Thrombin protease cleavage site.
VLPRLI

SEQ ID NO: 81 - protein, 6 aa, Artificial Sequence
  SITE (1)...(6): Thrombin protease cleavage site.
VMPRSL

SEQ ID NO: 82 - protein, 6 aa, Artificial Sequence
  SITE (1)...(6): Thrombin protease cleavage site.
MFPRSL

SEQ ID NO: 83 - protein, 4 aa, Artificial Sequence
  SITE (1)...(4): Coagulation Factor Xa protease cleavage site.
IDGR

SEQ ID NO: 84 - protein, 4 aa, Artificial Sequence
  SITE (1)...(4): Coagulation Factor Xa protease cleavage site.
IEGR

SEQ ID NO: 85 - protein, 1350 aa, Artificial Sequence [sequence omitted]

SEQ ID NO: 86 - protein, 1342 aa, Artificial Sequence
  PEPTIDE (1)...(1342): BoNT/A-ED-PAR1-Xa
MGPRRLLLVAACFSLCGPLLSARTRARRPESKATNATIEGRSFLLRNPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 87 - protein, 1345 aa, Artificial Sequence
  PEPTIDE (1)...(1345): BoNT/A-ED-PAR2-Trypsin
MRSPSAAWLLGAAILLAASLSCSGTIQGTNRSSKGRSLIGKVDGTSHVTGPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 88 - protein, 1337 aa, Artificial Sequence
  PEPTIDE (1)...(1337): BoNT/A-ED-PAR2-Xa
MRSPSAAWLLGAAILLAASLSCSGTIQGTNRSIEGRSLIGKVPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 89 - protein, 1347 aa, Artificial Sequence
  PEPTIDE (1)...(1347): BoNT/A-ED-PAR3-Thrombin
MKALIFAAAGLLLLLPTFCQSGMENDTNNLAKPTLPIKTFRGAPPNSFEEFPPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 90 - protein, 1339 aa, Artificial Sequence
  PEPTIDE (1)...(1339): BoNT/A-ED-PAR3-Xa
MKALIFAAAGLLLLLPTFCQSGMENDTNNLAKPTIEGRTFRGAPPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 91 - protein, 1356 aa, Artificial Sequence [sequence omitted]

SEQ ID NO: 92 - protein, 1348 aa, Artificial Sequence
  PEPTIDE (1)...(1348): BoNT/A-ED-PAR4-Xa
MWGRLLLWPLVLGFSLSGGTQTPSVYDESGSTGGGDDSTPSILIEGRGYPGQVPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 93 - protein, 1306 aa, Artificial Sequence
  PEPTIDE (1)...(1306): BoNT/A-TD-PAR1-Thrombin
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLPRSFLLRNPNDKYEPFALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 94 - protein, 1300 aa, Artificial Sequence
  PEPTIDE (1)...(1300): BoNT/A-TD-PAR1-Xa
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRSFLLRNALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 95 - protein, 1306 aa, Artificial Sequence
  PEPTIDE (1)...(1306): BoNT/A-TD-PAR2-Trypsin
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLGRSLIGKVDGTSHVTGALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 96 - protein, 1300 aa, Artificial Sequence
  PEPTIDE (1)...(1300): BoNT/A-TD-PAR2-Xa
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRSLIGKVALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 97 - protein, 1306 aa, Artificial Sequence
  PEPTIDE (1)...(1306): BoNT/A-TD-PAR3-Thrombin
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIKTFRGAPPNSFEEFPALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 98 - protein, 1300 aa, Artificial Sequence
  PEPTIDE (1)...(1300): BoNT/A-TD-PAR3-Xa
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRTFRGAPALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 99 - protein, 1306 aa, Artificial Sequence
  PEPTIDE (1)...(1306): BoNT/A-TD-PAR4-Thrombin
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLPRGYPGQVCANDSDTLALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 100 - protein, 1300 aa, Artificial Sequence
  PEPTIDE (1)...(1300): BoNT/A-TD-PAR4-Xa
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRGYPGQVALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 101 - protein, 1329 aa, Artificial Sequence
  PEPTIDE (1)...(1329): BoNT/A-BD-PAR1-Thrombin
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLPRSFLLRNPNDKYEPFALNDLFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPLALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 102 - protein, 1323 aa, Artificial Sequence
  PEPTIDE (1)...(1323): BoNT/A-BD-PAR1-Xa
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRSFLLRNALNDLFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPLALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 103 - protein, 1329 aa, Artificial Sequence
  PEPTIDE (1)...(1329): BoNT/A-BD-PAR2-Trypsin
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLGRSLIGKVDGTSHVTGALNDLFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPLALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 104 - protein, 1323 aa, Artificial Sequence
  PEPTIDE (1)...(1323): BoNT/A-BD-PAR2-Xa
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRSLIGKVALNDLFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPLALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 105 - protein, 1329 aa, Artificial Sequence
  PEPTIDE (1)...(1329): BoNT/A-BD-PAR3-Thrombin
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIKTFRGAPPNSFEEFPALNDLFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPLALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 106 - protein, 1323 aa, Artificial Sequence
  PEPTIDE (1)...(1323): BoNT/A-BD-PAR3-Xa
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRTFRGAPALNDLFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPLALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 107 - protein, 1329 aa, Artificial Sequence
  PEPTIDE (1)...(1329): BoNT/A-BD-PAR4-Thrombin
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLPRGYPGQVCANDSDTLALNDLFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPLALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 108 - protein, 1323 aa, Artificial Sequence
  PEPTIDE (1)...(1323): BoNT/A-BD-PAR4-Xa
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRGYPGQVALNDLFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPLALAGGGGSGGGGSGGGGSALVLQCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 109 - DNA, 4053 bp, Artificial Sequence
  mat_peptide (1)...(4050): Sequence encoding BoNT/A-ED-PAR1-Thrombin
atggggccgcggcggctgctgctggtggccgcctgcttcagtctgtgcggcccgctgttgtctgcccgcacccgggcccgcaggccagaatcaaaagcaacaaatgccaccttagatccccggtcatttcttctcaggaaccccaatgataaatatgaaccatttccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 110 - DNA, 4029 bp, Artificial Sequence
  mat_peptide (1)...(4026): Sequence encoding BoNT/A-ED-PAR1-Xa
atggggccgcggcggctgctgctggtggccgcctgcttcagtctgtgcggcccgctgttgtctgcccgcacccgggcccgcaggccagaatcaaaagcaacaaatgccaccatagaaggccggtcatttcttctcaggaacccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 111 - DNA, 4038 bp, Artificial Sequence
  mat_peptide (1)...(4035): Sequence encoding BoNT/A-ED-PAR2-Trypsin
atgcggagccccagcgcggcgtggctgctgggggccgccatcctgctagcagcctctctctcctgcagtggcaccatccaaggaaccaatagatcctctaaaggaagaagccttattggtaaggttgatggcacatcccacgtcactggaccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 112 - DNA, 4014 bp, Artificial Sequence
  mat_peptide (1)...(4011): Sequence encoding BoNT/A-ED-PAR2-Xa
atgcggagccccagcgcggcgtggctgctgggggccgccatcctgctagcagcctctctctcctgcagtggcaccatccaaggaaccaatagatccatagaaggaagaagccttattggtaaggttccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 113 - DNA, 4044 bp, Artificial Sequence
  mat_peptide (1)...(4041): Sequence encoding BoNT/A-ED-PAR3-Thrombin
atgaaagccctcatctttgcagctgctggcctcctgcttctgttgcccactttttgtcagagtggcatggaaaatgatacaaacaacttggcaaagccaaccttacccattaagacctttcgtggagctcccccaaattcttttgaagagttccccccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 114 - DNA, 4020 bp, Artificial Sequence
  mat_peptide (1)...(4017): Sequence encoding BoNT/A-ED-PAR3-Xa
atgaaagccctcatctttgcagctgctggcctcctgcttctgttgcccactttttgtcagagtggcatggaaaatgatacaaacaacttggcaaagccaaccatagaaggtagaacctttcgtggagctcccccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 115 - DNA, 4071 bp, Artificial Sequence
  mat_peptide (1)...(4068): Sequence encoding BoNT/A-ED-PAR4-Thrombin
atgtgggggcgactgctcctgtggcccctggtgctggggttcagcctgtctggcggcacccagacccccagcgtctacgacgagagcgggagcaccggaggtggtgatgacagcacgccctcaatcctgcctgccccccgcggctacccaggccaagtctgtgccaatgacagtgacaccctgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 116 - DNA, 4047 bp, Artificial Sequence
  mat_peptide (1)...(4044): Sequence encoding BoNT/A-ED-PAR4-Xa
atgtgggggcgactgctcctgtggcccctggtgctggggttcagcctgtctggcggcacccagacccccagcgtctacgacgagagcgggagcaccggaggtggtgatgacagcacgccctcaatcctgattgaaggccgcggctacccaggccaagtcccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 117 - DNA, 3921 bp, Artificial Sequence
  mat_peptide (1)...(3918): Sequence encoding BoNT/A-TD-PAR1-Thrombin
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaccccggtcatttcttctcaggaaccccaatgataaatatgaaccatttgcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 118 - DNA, 3903 bp, Artificial Sequence
  mat_peptide (1)...(3900): Sequence encoding BoNT/A-TD-PAR1-Xa
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaatagaaggccggtcatttcttctcaggaacgcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 119 - DNA, 3921 bp, Artificial Sequence
  mat_peptide (1)...(3918): Sequence encoding BoNT/A-TD-PAR2-Trypsin
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaggaagaagccttattggtaaggttgatggcacatcccacgtcactggagcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 120 - DNA, 3903 bp, Artificial Sequence
  mat_peptide (1)...(3900): Sequence encoding BoNT/A-TD-PAR2-Xa
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaatagaaggaagaagccttattggtaaggttgcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 121 - DNA, 3921 bp, Artificial Sequence
  mat_peptide (1)...(3918): Sequence encoding BoNT/A-TD-PAR3-Thrombin
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaattaagacctttcgtggagctcccccaaattcttttgaagagttccccgcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 122 - DNA, 3903 bp, Artificial Sequence
  mat_peptide (1)...(3900): Sequence encoding BoNT/A-TD-PAR3-Xa
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaatagaaggtagaacctttcgtggagctcccgcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 123 - DNA, 3921 bp, Artificial Sequence
  mat_peptide (1)...(3918): Sequence encoding BoNT/A-TD-PAR4-Thrombin
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaccccgcggctacccaggccaagtctgtgccaatgacagtgacaccctggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 124 - DNA, 3903 bp, Artificial Sequence
  mat_peptide (1)...(3900): Sequence encoding BoNT/A-TD-PAR4-Xa
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaattgaaggccgcggctacccaggccaagtcgcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 125 - DNA, 3987 bp, Artificial Sequence
  mat_peptide (1)...(3984): Sequence encoding BoNT/A-BD-PAR1-Thrombin
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaccccggtcatttcttctcaggaaccccaatgataaatatgaaccatttgcattaaatgatttatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactggcattggccggtggaggcggtagtggaggcggtgggtctggcggtgggggcagcgcgctggtgttacagtgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctaca

SEQ ID NO: 126 - DNA, 3969 bp, Artificial Sequence
  mat_peptide (1)...(3966): Sequence encoding BoNT/A-BD-PAR1-Xa
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaatagaaggccggtcatttcttctcaggaacgcattaaatgatttatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactggcattggccggtggaggcggtagtggaggcggtgggtctggcggtgggggcagcgcgctggtgttacagtgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctaca

SEQ ID NO: 127 - DNA, 3987 bp, Artificial Sequence
  mat_peptide (1)...(3984): Sequence encoding BoNT/A-BD-PAR2-Trypsin
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaggaagaagccttattggtaaggttgatggcacatcccacgtcactggagcattaaatgatttatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactggcattggccggtggaggcggtagtggaggcggtgggtctggcggtgggggcagcgcgctggtgttacagtgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctaca

SEQ ID NO: 128 - DNA, 3969 bp, Artificial Sequence
  mat_peptide (1)...(3966): Sequence encoding BoNT/A-BD-PAR2-Xa
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaatagaaggaagaagccttattggtaaggttgcattaaatgatttatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactggcattggccggtggaggcggtagtggaggcggtgggtctggcggtgggggcagcgcgctggtgttacagtgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctaca

SEQ ID NO: 129 - DNA, 3987 bp, Artificial Sequence
  mat_peptide (1)...(3984): Sequence encoding BoNT/A-BD-PAR3-Thrombin
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaattaagacctttcgtggagctcccccaaattcttttgaagagttccccgcattaaatgatttatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactggcattggccggtggaggcggtagtggaggcggtgggtctggcggtgggggcagcgcgctggtgttacagtgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctaca

SEQ ID NO: 130 - DNA, 3969 bp, Artificial Sequence
  mat_peptide (1)...(3966): Sequence encoding BoNT/A-BD-PAR3-Xa
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaatagaaggtagaacctttcgtggagctcccgcattaaatgatttatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactggcattggccggtggaggcggtagtggaggcggtgggtctggcggtgggggcagcgcgctggtgttacagtgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctaca

SEQ ID NO: 131 - DNA, 3987 bp, Artificial Sequence
  mat_peptide (1)...(3984): Sequence encoding BoNT/A-BD-PAR4-Thrombin
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaccccgcggctacccaggccaagtctgtgccaatgacagtgacaccctggcattaaatgatttatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactggcattggccggtggaggcggtagtggaggcggtgggtctggcggtgggggcagcgcgctggtgttacagtgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctaca

SEQ ID NO: 132 - DNA, 3969 bp, Artificial Sequence
  mat_peptide (1)...(3966): Sequence encoding BoNT/A-BD-PAR4-Xa
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattaattgaaggccgcggctacccaggccaagtcgcattaaatgatttatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcgtcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactggcattggccggtggaggcggtagtggaggcggtgggtctggcggtgggggcagcgcgctggtgttacagtgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctaca

SEQ ID NO: 133 - protein, 6 aa, Artificial Sequence
  PEPTIDE (1)...(6): Variant of hexapeptide comprising the tethered ligand of PAR1
SFFLKN

SEQ ID NO: 134 - protein, 6 aa, Artificial Sequence
  PEPTIDE (1)...(6): Hexapeptide comprising the tethered ligand of PAR3
SFNGNE

SEQ ID NO: 135 - protein, 6 aa, Artificial Sequence
  PEPTIDE (1)...(6): Hexapeptide comprising the tethered ligand of PAR4
SFPGQP

SEQ ID NO: 136 - DNA, 4053 bp, Artificial Sequence
  mat_peptide (1)...(4050): Expression optimized sequence encoding BoNTA-ED-Par1thrombin
atgggcccgcgtcgtctgctgctggttgctgcttgctttagcctgtgcggcccgctgctgagcgctcgtacccgtgctcgtcgtccggaatctaaagctaccaacgctaccctggacccgcgttccttcctgctgcgtaacccgaacgacaaatacgaaccgttcccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggtagcaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacactaacccgctgctgggcgctggtaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctggacaaaggctacaacaaagctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcattaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgagcgctctggaaatcccggacgtaggcaacctgtcccaggttgtagtaatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagattgaacgttcctcccgtaccctgggctgtagctgggaatttatcccggttgacgacggctggggcgaacgtccgctgtaa

SEQ ID NO: 137 - DNA, 4029 bp, Artificial Sequence
  mat_peptide (1)...(4026): Expression optimized sequence encoding BoNTA-ED-PAR1FactorXa
atgggcccgcgtcgtctgctgctggttgctgcttgcttctccctgtgcggcccgctgctgagcgctcgtacccgtgctcgtcgtccggaatctaaagctaccaacgctaccatcgaaggccgttccttcctgctgcgtaacccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgactagcatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcgaaggccgtaacaaagctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaagatttacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgagcgctctggaaatcccggacgttggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgtagctgggaattcatcccggttgacgacggctggggcgaacgtccgctgtaa

SEQ ID NO: 138 - DNA, 4038 bp, Artificial Sequence
  mat_peptide (1)...(4035): Expression optimized sequence encoding BoNTA-ED-PAR2trypsin
atgcgttccccgtccgctgcttggctgctgggcgctgctatcctgctggctgcttccctgagctgtagcggcaccatccagggcaccaaccgttcctccaaaggccgttccctgatcggcaaagttgacggcacctcccacgttaccggcccgttcgttaacaaacagttcaactacaaagacccggttaacggcgttgacatcgcttacatcaaaatcccgaacgctggccagatgcagccggttaaagctttcaaaatccacaacaaaatctgggttatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgactagcatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctggacaaaggctacaacaaagctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcattaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 139 - DNA, 4014 bp, Artificial Sequence
  mat_peptide (1)...(4011): Expression optimized sequence encoding BoNTA-ED-PAR2FactorXa
atgcgttccccgtccgctgcttggctgctgggcgctgctatcctgctggctgcttccctgagctgtagcggcaccatccagggcaccaaccgttccatcgaaggccgttccctgatcggcaaagttccgttcgttaacaaacagttcaactacaaagacccggttaacggcgttgacatcgcttacatcaaaatcccgaacgctggccagatgcagccggttaaagctttcaaaatccacaacaaaatctgggttatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcgaaggccgtaacaaagctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 140 - DNA, 4044 bp, Artificial Sequence
  mat_peptide (1)...(4041): Expression optimized sequence encoding BoNTA-ED-PAR3thrombin
atgaaagctctgatcttcgctgcagctggcctgctgctgctgctgccgaccttctgccagtccggcatggaaaacgacaccaacaacctggctaaaccgaccctgccgatcaaaaccttccgtggcgctccgccgaactccttcgaagaattcccgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctggacaaaggctacaacaaagctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 141 - DNA, 4020 bp, Artificial Sequence
  mat_peptide (1)...(4017): Expression optimized sequence encoding BoNTA-ED-PAR3FactorXa
atgaaagctctgatcttcgctgcagctggcctgctgctgctgctgccgaccttctgccagtccggcatggaaaacgacaccaacaacctggctaaaccgaccatcgaaggccgtaccttccgtggcgctccgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcgaaggccgtaacaaagctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaagagaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgagccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 142 - DNA, 4071 bp, Artificial Sequence
  mat_peptide (1)...(4068): Expression optimized sequence encoding BoNTA-ED-PAR4thrombin
atgtggggccgtctgctgctgtggccgctggttctgggcttctccctgagcggcggcacccagaccccgtccgtttatgacgaatccggctccaccggcggtggcgacgactccaccccgtccatcctgccggctccgcgtggctacccgggccaggtttgcgctaacgactccgacaccctgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctggacaaaggctacaacaaagctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgtaggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 143 - DNA, 4047 bp, Artificial Sequence
  mat_peptide (1)...(4044): Expression optimized sequence encoding BoNTA-ED-PAR4FactorXa
atgtggggccgtctgctgctgtggccgctggttctgggcttctccctgagcggcggcacccagaccccgtccgtttacgacgaatccggctccaccggcggtggcgacgactccaccccgtccatcctgatcgaaggccgtggctacccgggccaggttccgttcgttaacaaacagttcaactacaaagacccggttaacggcgttgacatcgcttacatcaaaatcccgaacgctggccagatgcagccggttaaagctttcaaaatccacaacaaaatctgggttatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcgaaggccgtaacaaagctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgagccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 144 - DNA, 3921 bp, Artificial Sequence
  mat_peptide (1)...(3918): Expression optimized sequence encoding BoNTA-TD-PAR1thrombin
atgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgccgcgttccttcctgctgcgtaacccgaacgacaaatacgaaccgttcgctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggagaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaagattaacatcggctccaaagttaacttcgacccgatcgacaagaaccagatccagctgttcaacctggaatcctccaagattgaagttatcctgaagaacgctatcgtttacaactccatgtacgagaacttctccacctccttctggatccgtatcccgaaatacttcaactccatctccctgaacaacgaatacaccatcatcaactgcatggagaacaactccggctggaaagtttccctgaactacggcgaaatcatctggaccctgcaggacacccaggaaatcaaacagcgtgttgtatttaaatactcccagatgatcaacatctccgactacatcaaccgttggatcttcgttaccatcaccaacaaccgtctgaacaactccaagatttacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgagccaagttgtagttatgaaatccaagaacgaccagggcatcaccaacaagtgcaagatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 145 - DNA, 3903 bp, Artificial Sequence
  mat_peptide (1)...(3900): Expression optimized sequence encoding BoNTA-TD-PAR1FactorXa
atgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcgaaggccgttccttcctgctgcgtaacgctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaagatttacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgagccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 146 - DNA, 3921 bp, Artificial Sequence
  mat_peptide (1)...(3918): Expression optimized sequence encoding BoNTA-TD-PAR2trypsin
atgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctctccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgtatttaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaagatgctgaccgaaatctacaccgaagacaacttcgttaaattcttcaaagttctgaaccgtaagacttacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaagactaaatccctgggccgttccctgatcggcaaagttgacggcacctcccacgttaccggcgctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggagaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgagaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 147 - DNA, 3903 bp, Artificial Sequence
  mat_peptide (1)...(3900): Expression optimized sequence encoding BoNTA-TD-PAR2FactorXa
atgccgttcgttaacaaacagttcaactacaaagacccggttaacggcgttgacatcgcttacatcaaaatcccgaacgctggccagatgcagccggttaaagctttcaagattcacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcgaaggccgttccctgatcggcaaagttgctctgaacgacctgtgcatcaaagttaacaactgggacctgttcttctctccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaagattgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggagaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 148 - DNA, 3921 bp, Artificial Sequence
  mat_peptide (1)...(3918): Expression optimized sequence encoding BoNTA-TD-PAR3thrombin
atgccgttcgttaacaaacagttcaactacaaagacccggttaacggcgttgacatcgcttacatcaaaatcccgaacgctggccagatgcagccggttaaagctttcaagattcacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctctccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgtatttaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaagactaaatccctgatcaaaaccttccgtggcgctccgccgaactccttcgaagaattcccggctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggagaacatctccatcgagaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaagattgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggagaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaagattaacatcggctccaaagttaacttcgacccgatcgacaagaaccagatccagctgttcaacctggaatcctccaagattgaagttatcctgaagaacgctatcgtttacaactccatgtacgagaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgtaggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 149 - DNA, 3903 bp, Artificial Sequence
  mat_peptide (1)...(3900): Expression optimized sequence encoding BoNTA-TD-PAR3FactorXa
atgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcgaaggccgtaccttccgtggcgctccggctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgagaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggagaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgagccaagttgtagttatgaaatccaagaacgaccagggcatcaccaacaagtgcaagatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 150 - DNA, 3921 bp, Artificial Sequence
  mat_peptide (1)...(3918): Expression optimized sequence encoding BoNTA-TD-PAR4thrombin
atgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctctccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgccgcgtggctacccgggccaggtttgcgctaacgactccgacaccctggctctgaacgacctgtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggagaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 151 - DNA, 3903 bp, Artificial Sequence
  mat_peptide (1)...(3900): Expression optimized sequence encoding BoNTA-TD-PAR4FactorXa
atgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctctccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaagatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcgaaggccgtggctacccgggccaggttgctctgaacgacctgtgcatcaaagttaacaactgggacctgttcttctctccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgagaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccaccttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctgtaa

SEQ ID NO: 152 - DNA, 3990 bp, Artificial Sequence
  mat_peptide (1)...(3987): Expression optimized sequence encoding BoNTA-BD-PAR1Thrombin
atgccgttcgttaacaaacagttcaactacaaagacccggttaacggcgttgacatcgcttacatcaaaatcccgaacgctggccagatgcagccggttaaagctttcaagattcacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccactgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctctccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaagatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgccgcgttccttcctgctgcgtaacccgaacgacaaatacgaaccgttcgctctgaacgacctgttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcattaactgcatggaaaacaactccggctggaaagtttccctgaactacggcgaaatcatctggaccctgcaggacacccaggaaatcaaacagcgtgttgttttcaaatactcccagatgattaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgtcccaagttgtagttatgaaatccaagaacgaccagggcatcaccaacaaatgcaagatgaacctgcaggacaacaacggcaacgacatcggcttcatcggcttccaccagttcaacaacatcgctaaactggttgcttccaactggtacaaccgtcagattgaacgtagctcccgtaccctgggctgtagctgggaattcatcccggttgacgacggctggggtgaacgtccgctggctctggctggcggtggcggtagcggcggtggcggttccggcggtggcggttccgctctggttctgcagtgcatcaaagttaacaactgggacctgttcttctctccgtctgaagacaacttcaccaacgacctgaacaaaggcgaagaaatcacctccgacaccaacatcgaagctgctgaagagaacatctccctggacctgatccagcagtactacctgaccttcaacttcgacaacgaaccggagaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaagagaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccacctaa

SEQ ID NO: 153 - DNA, 3972 bp, Artificial Sequence
  mat_peptide (1)...(3969): Expression optimized sequence encoding BoNTA-BD-PAR1FactorXa
atgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgactagcatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggtaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcgaaggccgttccttcctgctgcgtaacgctctgaacgacctgttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaattaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgagcgctctggaaatcccggacgttggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgtagctgggaattcatcccggttgacgacggctggggtgaacgtccgctggctctggctggcggtggcggtagcggcggtggcggtagcggcggtggcggtagcgctctggttctgcagtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccacctaa

SEQ ID NO: 154 - DNA, 3990 bp, Artificial Sequence
  mat_peptide (1)...(3987): Expression optimized sequence encoding BoNTA-BD-PAR2trypsin
atgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgggccgttccctgatcggcaaagttgacggcacctcccacgttaccggcgctctgaacgacctgttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaagattgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgtcccaagttgttgttatgaaatccaagaacgaccagggcatcaccaacaagtgcaagatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctggctctggctggcggtggcggttccggcggtggcggttccggcggtggcggttccgctctggttctgcagtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccacctaa

SEQ ID NO: 155 - DNA, 3972 bp, Artificial Sequence
  mat_peptide (1)...(3969): Expression optimized sequence encoding BoNTA-BD-PAR2FactorXa
atgccgttcgttaacaaacagttcaactacaaagacccggttaacggcgttgacatcgcttacatcaaaatcccgaacgctggccagatgcagccggttaaagctttcaaaatccataacaagatttgggtaatcccggaacgtgacaccttcaccaacccggaagaaggtgacctgaacccgccgccggaagctaaacaggttccggtttcctactacgactccacctacctgtccaccgacaacgagaaggacaactacctgaaaggcgttaccaaactgttcgaacgtatctactccactgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctctccggacttcaccttcggcttcgaagaatccctggaagttgacactaacccgctgctgggcgctggtaaattcgctaccgacccggctgtaaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcgaaggccgttccctgatcggcaaagttgctctgaacgacctgttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggtgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgagcgctctggaaatcccggacgttggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgtagctgggaattcatcccggttgacgacggctggggtgaacgtccgctggctctggctggcggtggcggtagcggcggtggcggtagcggcggtggcggttccgctctggttctgcagtgcatcaaagttaacaactgggacctgttcttctctccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctatgacaaccgtggcaccctgatcggccaggttgaccgtctgaaagacaaagttaacaacaccctgtccaccgacatcccgttccagctgtccaaatacgttgacaaccagcgtctgctgtccacctaa

SEQ ID NO: 156 - DNA, 3990 bp, Artificial Sequence
  mat_peptide (1)...(3987): Expression optimized sequence encoding BoNTA-BD-PAR3thrombin
atgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcaaaaccttccgtggcgctccgccgaactccttcgaagaattcccggctctgaacgacctgttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgagccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagattgaacgtagctcccgtaccctgggctgtagctgggaattcatcccggttgacgacggctggggtgaacgtccgctggctctggctggcggtggcggtagcggcggtggcggttccggcggtggcggttccgctctggttctgcagtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccacctaa

SEQ ID NO: 157 - DNA, 3972 bp, Artificial Sequence
  mat_peptide (1)...(3969): Expression optimized sequence encoding BoNTA-BD-PAR3FactorXa
atgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcgaaggccgtaccttccgtggcgctccggctctgaacgacctgttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgctcctgggaattcatcccggttgacgacggctggggcgaacgtccgctggctctggctggcggtggcggtagcggcggtggcggtagcggcggtggcggttccgctctggttctgcagtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccacctaa

SEQ ID NO: 158 - DNA, 3990 bp, Artificial Sequence
  mat_peptide (1)...(3987): Expression optimized sequence encoding BoNTA-BD-PAR4thrombin
atgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaagactaaatccctgccgcgtggctacccgggccaggtttgcgctaacgactccgacaccctggctctgaacgacctgttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaagattgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgagccaagttgtagttatgaaatccaagaacgaccagggcatcaccaacaagtgcaagatgaacctgcaggacaacaacggcaacgacatcggcttcatcggcttccaccagttcaacaacatcgctaaactggttgcttccaactggtacaaccgtcagatcgaacgtagctcccgtaccctgggctgtagctgggaattcatcccggttgacgacggctggggtgaacgtccgctggctctggctggcggtggcggtagcggcggtggcggttccggcggtggcggttccgctctggttctgcagtgcatcaaagttaacaactgggacctgttcttctctccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccacctaa

SEQ ID NO: 159 - DNA, 3972 bp, Artificial Sequence
  mat_peptide (1)...(3969): Expression optimized sequence encoding BoNTA-BD-PAR4FactorXa
atgccgttcgttaacaaacagttcaactacaaagacccggttaacggcgttgacatcgcttacatcaaaatcccgaacgctggccagatgcagccggttaaagctttcaaaatccacaacaaaatctgggtaatcccggaacgtgacaccttcaccaacccggaagaaggcgacctgaacccgccgccggaagctaaacaggttccggtttcctactacgactccacctacctgtccaccgacaacgagaaggacaactacctgaaaggcgttaccaaactgttcgaacgtatctactccaccgacctgggccgtatgctgctgacctccatcgttcgtggcatcccgttctggggcggctccaccatcgacaccgaactgaaagttatcgacaccaactgcatcaacgttatccagccggacggctcctaccgttccgaagaactgaacctggttatcatcggcccgtccgctgacatcatccagttcgaatgcaaatccttcggccacgaagttctgaacctgacccgtaacggctacggctccacccagtacatccgtttctccccggacttcaccttcggcttcgaagaatccctggaagttgacaccaacccgctgctgggcgctggcaaattcgctaccgacccggctgttaccctggctcacgaactgatccacgctggccaccgtctgtacggcatcgctatcaacccgaaccgtgttttcaaagttaacaccaacgcttactacgaaatgtccggcctggaagtttccttcgaagaactgcgtaccttcggcggccacgacgctaaattcatcgactccctgcaggaaaacgaattccgtctgtactattacaacaaattcaaagacatcgcttccaccctgaacaaagctaaatccatcgttggcaccaccgcttccctgcagtacatgaagaacgttttcaaagagaagtacctgctgtccgaagacacctccggcaaattctccgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggcttcaacctgcgtaacaccaacctggctgctaacttcaacggccagaacaccgaaatcaacaacatgaacttcaccaaactgaagaacttcaccggcctgttcgaattctacaaactgctgtgcgttcgtggcatcatcacctccaaaaccaaatccctgatcgaaggccgtggctacccgggccaggttgctctgaacgacctgttcaccgaatacatcaagaacatcatcaacacctccatcctgaacctgcgttacgaatccaaccacctgatcgacctgtcccgttacgcttccaaaatcaacatcggctccaaagttaacttcgacccgatcgacaagaaccagatccagctgttcaacctggaatcctccaaaatcgaagttatcctgaagaacgctatcgtttacaactccatgtacgaaaacttctccacctccttctggatccgtatcccgaaatacttcaactccatctccctgaacaacgaatacaccatcatcaactgcatggaaaacaactccggctggaaagtttccctgaactacggcgaaatcatctggaccctgcaggacacccaggaaatcaaacagcgtgttgttttcaaatactcccagatgatcaacatctccgactacatcaaccgttggatcttcgttaccatcaccaacaaccgtctgaacaactccaaaatctacatcaacggccgtctgatcgaccagaaaccgatctccaacctgggcaacatccacgcttccaacaacatcatgttcaaactggacggctgccgtgacacccaccgttacatctggatcaaatacttcaacctgttcgacaaagaactgaacgagaaggaaatcaaagacctgtacgacaaccagtccaactccggcatcctgaaagacttctggggcgactacctgcagtatgacaaaccgtactacatgctgaacctgtacgacccgaacaaatacgttgacgttaacaacgttggcatccgtggctacatgtacctgaaaggcccgcgtggctccgttatgaccaccaacatctacctgaactcctccctgtaccgtggcaccaaattcatcatcaagaagtacgcttccggcaacaaagacaacatcgttcgtaacaacgaccgtgtttacatcaacgttgtagttaagaacaaagaataccgtctggctaccaacgcttcccaggctggcgttgagaagattctgtccgctctggaaatcccggacgttggcaacctgtcccaagttgtagttatgaaatccaagaacgaccagggcatcaccaacaagtgcaaaatgaacctgcaggacaacaacggcaacgacatcggcttcatcggcttccaccagttcaacaacatcgctaaactggttgcttccaactggtacaaccgtcagatcgaacgttcctcccgtaccctgggctgtagctgggaattcatcccggttgacgacggctggggtgaacgtccgctggctctggctggcggtggcggtagcggcggtggcggtagcggcggtggcggttccgctctggttctgcagtgcatcaaagttaacaactgggacctgttcttctccccgtccgaagacaacttcaccaacgacctgaacaaaggcgaagaaatcacctccgacaccaacatcgaagctgctgaagaaaacatctccctggacctgatccagcagtactacctgaccttcaacttcgacaacgaaccggaaaacatctccatcgaaaacctgtcctccgacatcatcggccagctggaactgatgccgaacatcgaacgtttcccgaacggcaagaagtatgaactggacaaatacaccatgttccactacctgcgtgctcaggaattcgaacacggcaaatcccgtatcgctctgaccaactccgttaacgaagctctgctgaacccgtcccgtgtttacaccttcttctcctccgactacgttaagaaggttaacaaagctaccgaagctgctatgttcctgggctgggttgaacagctggtttacgacttcaccgacgaaacctccgaagtttccaccaccgacaaaatcgctgacatcaccatcattatcccgtacatcggcccggctctgaacatcggcaacatgctgtacaaagacgacttcgttggcgctctgatcttctccggcgctgttatcctgctggaattcatcccggaaatcgctatcccggttctgggcaccttcgctctggtttcctacatcgctaacaaagttctgaccgttcagaccatcgacaacgctctgtccaaacgtaacgagaagtgggacgaagtttacaaatacatcgttaccaactggctggctaaagttaacacccagatcgacctgatccgtaagaagatgaaagaagctctggaaaaccaggctgaagctaccaaagctatcatcaactaccagtacaaccagtacaccgaagaggaaaagaacaacatcaacttcaacatcgacgacctgtcctccaaactgaacgaatccatcaacaaagctatgatcaacatcaacaaattcctgaaccagtgctccgtttcctacctgatgaactccatgatcccgtacggcgttaaacgtctggaagacttcgacgcttccctgaaagacgctctgctgaaatacatctacgacaaccgtggcaccctgatcggccaggttgaccgtctgaaagacaaagttaacaacaccctgtccaccgacatcccgttccagctgtccaaatacgttgacaaccagcgtctgctgtccacctaa

SEQ ID NO: 160 - protein, 6 aa, Artificial Sequence
  PEPTIDE (1)...(6): Variant of hexapeptide comprising the tethered ligand of PAR4
SFPGQA

What is claimed:

1. A modified Clostridial toxin comprising:
   a) a protease-activated G protein-coupled receptor (PAR) ligand domain, wherein the PAR ligand domain comprises a masked or unmasked PAR ligand domain, and wherein the unmasked PAR ligand domain binds to a PAR ligand binding domain of a target cell under physiological conditions;
   b) a Clostridial toxin enzymatic domain that proteolytically cleaves a substrate of a Clostridial toxin;
   c) a Clostridial toxin translocation domain that executes a translocation step of a Clostridial toxin intoxication process; and
   d) a Clostridial toxin binding domain that that executes a cell binding step of a Clostridial toxin intoxication process.

2. The modified Clostridial toxin according to claim 1, wherein the PAR ligand domain is operationally-linked to the amino terminus of the Clostridial toxin enzymatic domain.

3. The modified Clostridial toxin according to claim 2, wherein the modified Clostridial toxin comprises an amino to carboxyl single polypeptide linear order comprising the PAR ligand domain, the Clostridial toxin enzymatic domain, the Clostridial toxin translocation domain and the Clostridial toxin binding domain.

4. The modified Clostridial toxin according to claim 2, wherein the modified Clostridial toxin comprises an amino to carboxyl single polypeptide linear order comprising the PAR ligand domain, the Clostridial toxin enzymatic domain, the Clostridial toxin binding domain and the Clostridial toxin translocation domain.

5. The modified Clostridial toxin according to claim 1, wherein the PAR ligand domain is operationally-linked to the amino terminus of the Clostridial toxin translocation domain.

6. The modified Clostridial toxin according to claim 5, wherein the modified Clostridial toxin comprises an amino to carboxyl single polypeptide linear order comprising the Clostridial toxin binding domain, the Clostridial toxin enzymatic domain, the PAR ligand domain and the Clostridial toxin translocation domain.

7. The modified Clostridial toxin according to claim 5, wherein the modified Clostridial toxin comprises an amino to carboxyl single polypeptide linear order comprising the Clostridial toxin enzymatic domain, the PAR ligand domain, the Clostridial toxin translocation domain and the Clostridial toxin binding domain.

8. The modified Clostridial toxin according to claim 1, wherein the PAR ligand domain is operationally-linked to the amino terminus of the Clostridial toxin binding domain.

9. The modified Clostridial toxin according to claim 8, wherein the modified Clostridial toxin comprises an amino to carboxyl single polypeptide linear order comprising the Clostridial toxin enzymatic domain, the PAR ligand domain, the Clostridial toxin binding domain and the Clostridial toxin translocation domain.

10. The modified Clostridial toxin according to claim 1, wherein the modified Clostridial toxin further comprises a protease cleavage site in the masked PAR ligand domain; and wherein cleavage of the protease cleavage site unmasks the PAR ligand domain.

11. The modified Clostridial toxin according to claim 1, wherein the PAR ligand domain comprises a PAR1 ligand domain.

12. The modified Clostridial toxin according to claim 11, wherein the PAR1 ligand Domain comprises SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23 or SEQ ID NO: 133.

13. The modified Clostridial toxin according to claim 1, wherein the PAR ligand domain comprises a PAR2 ligand domain.

14. The modified Clostridial toxin according to claim 13, wherein the PAR2 ligand domain comprises SEQ ID NO: 24 or SEQ ID NO: 25.

15. The modified Clostridial toxin according to claim 1, wherein the PAR ligand domain comprises a PAR3 ligand domain.

16. The modified Clostridial toxin according to claim 15, wherein the PAR3 ligand domain comprises SEQ ID NO: 26, SEQ ID NO: 27 or SEQ ID NO: 134.

17. The modified Clostridial toxin according to claim 1, wherein the PAR ligand domain comprises a PAR4 ligand domain.

18. The modified Clostridial toxin according to claim 17, wherein the PAR4 ligand domain comprises SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 135 or SEQ ID NO: 160.

19. The modified Clostridial toxin according to claim 1, wherein the modified Clostridial toxin is a modified Botulinum toxin comprising a PAR ligand domain, a Botulinum toxin enzymatic domain, a Botulinum toxin translocation domain and a Botulinum toxin binding domain.

20. The modified Clostridial toxin according to claim 19, wherein the modified Botulinum toxin is a modified BoNT/A comprising a PAR ligand domain, a BoNT/A enzymatic domain, a BoNT/A translocation domain and a BoNT/A binding domain.

21. The modified Clostridial toxin according to claim 19, wherein the modified Botulinum toxin is a modified BoNT/B comprising a PAR ligand domain, a BoNT/B enzymatic domain, a BoNT/B translocation domain and a BoNT/B binding domain.

22. The modified Clostridial toxin according to claim 19, wherein the modified Botulinum toxin is a modified BoNT/C1 comprising a PAR ligand domain, a BoNT/C1 enzymatic domain, a BoNT/C1 translocation domain and a BoNT/C1 binding domain.

23. The modified Clostridial toxin according to claim 19, wherein the modified Botulinum toxin is a modified BoNT/D comprising a PAR ligand domain, a BoNT/D enzymatic domain, a BoNT/D translocation domain and a BoNT/D binding domain.

24. The modified Clostridial toxin according to claim 19, wherein the modified Botulinum toxin is a modified BoNT/E comprising a PAR ligand domain, a BoNT/E enzymatic domain, a BoNT/E translocation domain and a BoNT/E binding domain.

25. The modified Clostridial toxin according to claim 19, wherein the modified Botulinum toxin is a modified BoNT/F comprising a PAR ligand domain, a BoNT/F enzymatic domain, a BoNT/F translocation domain and a BoNT/F binding domain.

26. The modified Clostridial toxin according to claim 19, wherein the modified Botulinum toxin is a modified BoNT/G comprising a PAR ligand domain, a BoNT/G enzymatic domain, a BoNT/G translocation domain and a BoNT/G binding domain.

27. The modified Clostridial toxin according to claim 1, wherein the modified Clostridial toxin is a modified Tetanus toxin comprising a PAR ligand domain, a Tetanus toxin enzymatic domain, a Tetanus toxin translocation domain and a Tetanus toxin binding domain.

28. An isolated polynucleotide molecule encoding a modified Clostridial toxin, the polynucleotide molecule encoding the modified Clostridial toxin of claim 1.

29. A method of producing a modified Clostridial toxin comprising the steps of:
 a) introducing into host cell the polynucleotide molecule of claim 28; and
 b) expressing the modified Clostridial toxin encoded by the polynucleotide molecule under conditions suitable for expression of the modified Clostridial toxin.

* * * * *

UNITED STATES PATENT AND TRADEMARK OFFICE
CERTIFICATE OF CORRECTION

PATENT NO. : 7,892,565 B2
APPLICATION NO. : 11/572512
DATED : February 22, 2011
INVENTOR(S) : Lance E. Steward et al.

It is certified that error appears in the above-identified patent and that said Letters Patent is hereby corrected as shown below:

On Title page 2, under "OTHER PUBLICATIONS", line 15, delete "interation"," and insert -- interaction", --, therefor.

In column 4, line 4-5, delete "neurotransmifter" and insert -- neurotransmitter --, therefor.

In column 6, line 4, delete "PAR1Thrombin" and insert -- PAR1 Thrombin --, therefor In column 7, line 44, delete "PcMV," and insert -- $P_{CMV}$, --, therefor.

In column 11, line 13, delete "HC" and insert -- $H_C$ --, therefor.

In column 16, line 2, delete "interleukin-8" and insert -- Interleukin-8 --, therefor.

In column 19, line 62, delete "BoNT/β" and insert -- BoNT/B --, therefor.

In column 30, line 48, delete "where as," and insert -- whereas, --, therefor.

In column 42, line 38, delete "can not" and insert -- cannot --, therefor.

In column 48, line 19, delete "hemagluttinin" and insert -- hemagglutinin --, therefor.

In column 52, line 55, delete "neurotransmifter" and insert -- neurotransmitter --, therefor.

In column 78, line 31, delete "tranfection," and insert -- transfection, --, therefor.

In column 81, line 9, delete "Clonetech," and insert -- Clontech, --, therefor.

In column 81, line 11, delete "Clonetech," and insert -- Clontech, --, therefor.

Signed and Sealed this
Twentieth Day of December, 2011

David J. Kappos
*Director of the United States Patent and Trademark Office*

CERTIFICATE OF CORRECTION (continued)
U.S. Pat. No. 7,892,565 B2

In column 82, line 20, delete "Bac-to-Bac" and insert -- Bac-to-Bac® --, therefor.

In column 82, line 21, delete "Pharmigen," and insert -- Pharmingen, --, therefor.

In column 92, line 7, delete "Coli" and insert -- coli --, therefor.

In column 93, line 53-54, delete "50/g/mL" and insert -- 50 μg/mL --, therefor.

In column 94, line 55, delete "calorimetric" and insert -- colorimetric --, therefor.

In column 95, line 38, delete "MultiImager" and insert -- MultiImager --, therefor.

In column 95, line 61, delete "monolaureate," and insert -- monolaurate, --, therefor.

In column 95, line 65, delete "monolaureate)" and insert -- monolaurate) --, therefor.

In column 98, line 8, delete "pastors" and insert -- pastoris --, therefor.

In column 100, line 35, delete "B-glucuronidase" and insert -- β-glucuronidase --, therefor.

In column 105, line 28, in claim 1, after "domain that" delete "that".

In column 106, line 26, in claim 12, delete "Domain" and insert -- domain --, therefor.

In column 108, line 17, in claim 29, delete "into" and insert -- into a --, therefor.